(12) United States Patent
Fitzgerald et al.

(10) Patent No.: US 7,875,711 B2
(45) Date of Patent: Jan. 25, 2011

(54) COMPOSITIONS AND METHODS FOR INHIBITING EXPRESSION OF XBP-1 GENE

(75) Inventors: Kevin Fitzgerald, Brookline, MA (US); Gregory Hinkle, Plymouth, MA (US)

(73) Assignee: Alnylam Pharamaceuticals, Inc., Cambridge, MA (US)

(*) Notice: Subject to any disclaimer, the term of this patent is extended or adjusted under 35 U.S.C. 154(b) by 0 days.

(21) Appl. No.: 12/425,811

(22) Filed: Apr. 17, 2009

(65) Prior Publication Data

US 2009/0275638 A1 Nov. 5, 2009

Related U.S. Application Data

(60) Provisional application No. 61/045,947, filed on Apr. 17, 2008, provisional application No. 61/078,302, filed on Jul. 3, 2008, provisional application No. 61/081,861, filed on Jul. 18, 2008.

(51) Int. Cl.
 *C07H 21/04* (2006.01)
(52) U.S. Cl. ............. 536/24.5; 536/24.1; 536/24.31; 514/44
(58) Field of Classification Search .............. None
 See application file for complete search history.

(56) References Cited

U.S. PATENT DOCUMENTS

| | | | |
|---|---|---|---|
| 2003/0143732 | A1 | 7/2003 | Fosnaugh et al. |
| 2004/0259247 | A1 | 12/2004 | Tuschl et al. |
| 2007/0004664 | A1 | 1/2007 | McSwiggen et al. |
| 2007/0031844 | A1 | 2/2007 | Khvorova et al. |

OTHER PUBLICATIONS

Huang Ihi-Ming et al: "Activation of hepatitis B virus S promoter by a cell type-restricted IREI-dependent pathway induced by endoplasmic reticulum stress." Molecular and Cellular Biology Sep. 2005, vol. 25, No. 17, Sep. 2005, pp. 7522-7533.
Lee Ann-Hwee et al: "Proteasome inhibitors disrupt the unfolded protein response in myeloma cells" Proceedings of the National Academy of Sciences of USA, National Academy of Science, Washington, DC, US, vol. 100, No. 17, Aug. 19, 2003, pp. 9946-9951.
Romero-Ramirez Lorenzo et al: "XBPI is essential for survival under hypoxic conditions and is required for tumor growth." Cancer Research Sep. 1, 2004, vol. 64, No. 17, Sep. 1, 2004, pp. 5943-5947.
Yu Chia-Yi et al: "Flavivirus infection activates the XBP1 pathway of the unfolded protein response to cope with endoplasmic reticulum stress." Journal of Virology Dec. 2006, vol. 80, No. 23, Dec. 2006, pp. 11868-11880.
International Search Report and Written Opinion, PCT/US2009/040962, Nov. 24, 2009, 15 Pages.
Invitation of Pay Additional Fees and, Where Applicable, Protest Fee, Communication Relating to the Results of the Partial International Search, PCT/US2009/040962, Oct. 5, 2009, 7 Pages.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.
Elbashir, S., et al., "RNA Interference is Mediated By 21-and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in *Caenorhabditis elegans*," Nature, Feb. 19, 1998, pp. 806-811, vol. 391.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation By Double-Stranded RNA in Vitro," Genes & Development, 1999, pp. 3191-3197, vol. 13.
Tuschl, T., "Expanding small RNA interference," Nature Biotechnology, May 2002, pp. 446-448, vol. 20.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
Lee, A.-H., et al., "Regulation of Hepatic Lipogenesis by the Transcription Factor XBP1," Science, Jun. 13, 2008, pp. 1492-1496, vol. 320.

*Primary Examiner*—Kimberly Chong
(74) *Attorney, Agent, or Firm*—Fenwick & West LLP

(57) ABSTRACT

The invention relates to a double-stranded ribonucleic acid (dsRNA) targeting X-Box Protein 1 (XBP-1), and methods of using the dsRNA to inhibit expression of XBP-1.

28 Claims, 6 Drawing Sheets

▼ =other cleavage sites found

FIG. 2

```
GGCGCTGGGCGGCTGCGGCGCGCGGTGCGCGGTGCGTAGTCTGGAGCTATGGTGGTGGTGGCAGCCG
CGCCGAACCCGGCCGACGGGACCCCTAAAGTTCTGCTTCTGTCGGGGCAGCCCGCCTCCGCCGCCGG
AGCCCCGGCCGGCCAGGCCCTGCCGCTCATGGTGCCAGCCCAGAGAGGGGCCAGCCCGGAGGCAGCG
AGCGGGGGCTGCCCCAGGCGCGCAAGCGACAGCGCCTCACGCACCTGAGCCCCGAGGAGAAGGCGC
TGAGGAGGAAACTGAAAAACAGAGTAGCAGCTCAGACTGCCAGAGATCGAAAGAAGGCTCGAATGAG
TGAGCTGGAACAGCAAGTGGTAGATTTAGAAGAAGAGAACCAAAAACTTTTGCTAGAAAATCAGCTT
TTACGAGAGAAAACTCATGGCCTTGTAGTTGAGAACCAGGAGTTAAGACAGCGCTTGGGGATGGATG
CCCTGGTTGCTGAAGAGGAGGCGGAAGCCAAGGGGAATGAAGTGAGGCCAGTGGCCGGGTCTGCTGA
GTCCGCAGCACTCAGACTACGTGCACCTCTGCAGCAGGTGCAGGCCCAGTTGTCACCCCTCCAGAAC
ATCTCCCCATGGATTCTGGCGGTATTGACTCTTCAGATTCAGAGTCTGATATCCTGTTGGGCATTCT
GGACAACTTGGACCCAGTCATGTTCTTCAAATGCCCTTCCCCAGAGCCTGCCAGCCTGGAGGAGCTC
CCAGAGGTCTACCCAGAAGGACCCAGTTCCTTACCAGCCTCCCTTTCTCTGTCAGTGGGGACGTCAT
CAGCCAAGCTGGAAGCCATTAATGAACTAATTCGTTTTGACCACATATATACCAAGCCCCTAGTCTT
AGAGATACCCTCTGAGACAGAGAGCCAAGCTAATGTGGTAGTGAAAATCGAGGAAGCACCTCTCAGC
CCCTCAGAGAATGATCACCCTGAATTCATTGTCTCAGTGAAGGAAGAACCTGTAGAAGATGACCTCG
TTCCGGAGCTGGGTATCTCAAATCTGCTTTCATCCAGCCACTGCCCAAAGCCATCTTCCTGCCTACT
GGATGCTTACAGTGACTGTGGATACGGGGGTTCCCTTTCCCCATTCAGTGACATGTCCTCTCTGCTT
GGTGTAAACCATTCTTGGGAGGACACTTTTGCCAATGAACTCTTTCCCCAGCTGATTAGTGTCTAAG
GAATGATCCAATACTGTTGCCCTTTTCCTTGACTATTACACTGCCTGGAGGATAGCAGAGAAGCCTG
TCTGTACTTCATTCAAAAGCCAAAATAGAGAGTATACAGTCCTAGAGAATTCCTCTATTTGTTCAG
ATCTCATAGATGACCCCCAGGTATTGTCTTTTGACATCCAGCAGTCCAAGGTATTGAGACATATTAC
TGGAAGTAAGAAATATTACTATAATTGAGAACTACAGCTTTTAAGATTGTACTTTTATCTTAAAAGG
GTGGTAGTTTTCCCTAAAATACTTATTATGTAAGGGTCATTAGACAAATGTCTTGAAGTAGACATGG
AATTTATGAATGGTTCTTTATCATTTCTCTTCCCCCTTTTTGGCATCCTGGCTTGCCTCCAGTTTTA
GGTCCTTTAGTTTGCTTCTGTAAGCAACGGGAACACCTGCTGAGGGGCTCTTTCCCTCATGTATAC
TTCAAGTAAGATCAAGAATCTTTTGTGAAATTATAGAAATTTACTATGTAAATGCTTGATGGAATTT
TTTCCTGCTAGTGTAGCTTCTGAAAGGTGCTTTCTCCATTTATTTAAAACTACCCATGCAATTAAAA
GGTACAATGCAAAAAAAAAAAAAAAA
```

FIG. 3

```
GCGGCGCTGGCGTAGACGTTTCCTGGCTATGGTGGTGGTGGCAGCGGCGCCGAGCGCGGCCACGGCG
GCCCCCAAAGTGCTACTCTTATCTGGCCAGCCCGCCTCCGGCGGCCGGGCGCTGCCGCTCATGGTAC
CCGGTCCGCGGGCAGCAGGGTCGGAGGCGAGCGGGACACCGCAGGCTCGCAAGCGGCAGCGGCTCAC
GCACCTGAGCCCGGAGGAGAAAGCGCTGCGGAGGAAACTGAAAAACAGAGTAGCAGCGCAGACTGCT
CGAGATAGAAAGAAAGCCCGGATGAGCGAGCTGGAGCAGCAAGTGGTGGATTTGGAAGAAGAGAACC
ACAAACTCCAGCTAGAAAATCAGCTTTTACGGGAGAAAACTCACGGCCTTGTGGTTGAGAACCAGGA
GTTAAGAACACGCTTGGGAATGGACACGCTGGATCCTGACGAGGTTCCAGAGGTGGAGGCCAAGGGG
AGTGGAGTAAGGCTGGTGGCCGGGTCTGCTGAGTCCGCAGCACTCAGACTATGTGCACCTCTGCAGC
AGGTGCAGGCCCAGTTGTCACCTCCCCAGAACATCTTCCCATGGACTCTGACACTGTTGCCTCTTCA
GATTCTGAGTCTGATATCCTTTGGGCATTCTGGACAAGTTGGACCCTGTCATGTTTTTCAAATGTC
CTTCCCCAGAGTCTGCTAGTCTGGAGGAACTCCCAGAGGTCTACCCAGAAGGACCTAGTTCCTTACC
AGCCTCCCTTTCTCTGTCAGTGGGGACCTCATCAGCCAAGCTGGAAGCCATTAATGAACTCATTCGT
TTTGACCATGTATACACCAAGCCTCTAGTTTTAGAGATCCCCTCTGAGACAGAGAGTCAAACTAACG
TGGTAGTGAAAATTGAGGAAGCACCTCTAAGCTCTTCAGAAGAGGATCACCCTGAATTCATTGTCTC
AGTGAAGAAAGAGCCTTTGGAAGATGACTTCATCCCAGAGCTGGGCATCTCAAACCTGCTTTCATCC
AGCCATTGTCTGAGACCACCTTCTTGCCTGCTGGACGCTCACAGTGACTGTGGATATGAGGGCTCCC
CTTCTCCCTTCAGTGACATGTCTTCTCCACTTGGTACAGACCACTCCTGGGAGGATACTTTTGCCAA
TGAACTTTTCCCCCAGCTGATTAGTGTCTAAAGAGCCACATAACACTGGGCCCCTTTCCCTGACCAT
CACATTGCCTAGAGGATAGCATAGGCCTGTCTCTTTCGTTAAAAGCCAAAGTAGAGGCTGTCTGGCC
TTAGAAGAATTCCTCTAAAGTATTTCAAATCTCATAGATGACTTCCAAGTATTGTCGTTTGACACTC
AGCTGTCTAAGGTATTCAAAGGTATTCCAGTACTACAGCTTTTGAGATTCTAGTTTATCTTAAAGGT
GGTAGTATACTCTAAATCGCAGGGAGGGTCATTTGACAGTTTTTTCCCAGCCTGGCTTCAAACTATG
TAGCCGAGGCTAGGCAGAAACTTCTGACCCTCTTGACCCCACCTCCCAAGTGCTGGGCTTCACCAGG
TGTGCACCTCCACACCTGCCCCCCCGACATGTCAGGTGGACATGGGATTCATGAATGGCCCTTAGCA
TTTCTTTCTCCACTCTCTGCTTCCCAGGTTTCGTAACCTGAGGGGGCTTGTTTTCCCTTATGTGCAT
TTTAAATGAAGATCAAGAATCTTTGTAAAATGATGAAAATTTACTATGTAAATGCTTGATGGATCTT
CTTGCTAGTGTAGCTTCTAGAAGGTGCTTTCTCCATTTATTTAAAACTACCCTTGCAAAAAAAAAAA
AAAAAAAA
```

FIG. 4

```
TGGCTATGGTGGTGGTGGCAGCGGCGCCGAGCGCGGCCTCGGCGGCCCCCAAAGTGCTACTCCTAT
CTGGTCAGCCCGCCTCCGGCGGCCGAGCGCTGCCGCTCATGGTTCCGGGCCCGCGAGCCGCAGGGT
CGGAGGCGAGCGGGACACCGCAGGCTCGCAAGCGGCAGCGCCTCACGCACCTGAGCCCGGAGGAGA
AAGCGCTGCGGAGGAAACTGAAAAACAGAGTAGCAGCACAGACTGCGCGAGATAGAAAGAAAGCCC
GGATGAGCGAGCTGGAGCAGCAAGTGGTGGATTTGGAAGAAGAGAACCAGAAACTCCAGCTAGAAA
ATCAGCTTTTACGAGAGAAAACTCATGGGCTTGTGATTGAGAACCAGGAGTTAAGGACACGCTTGG
GGATGAATGCCCTGGTTACTGAAGAGGTCTCAGAGGCAGAGTCCAAGGGGAATGGAGTAAGGCTGG
TGGCCGGGTCTGCTGAGTCCGCAGCACTCAGACTACGTGCGCCTCTGCAGCAGGTGCAGGCCCAGT
TGTCACCTCCCCAGAACATCTTCCCATGGATTCTGACGCTGTTGCCTCTTCAGATTCTGAGTCTGA
TATCCTTTTGGGCATTCTGGACAAGTTGGACCCTGTCATGTTTTTCAAATGTCCTTCCCCAGAGTC
TGCTAATCTGGAGGAACTCCCAGAGGTCTACCCAGAAGGACCTAGTTCCTTACCAGCCTCCCTTTC
TCTGTCAGTGGGGACCTCATCAGCCAAGCTGGAAGCCATTAATGAACTCATTCGTTTTGACCATGT
ATACACCAAGCCTCTAGTCTTAGAGATCCCTCTGAGACAGAGAGCCAAACTAATGTGGTAGTGAA
AATTGAGGAAGCACCTCTAAGCTCTTCAGAAGAGGATCACCCTGAATTCATTGTCTCAGTGAAGAA
AGAACCTTTGGATGATGACTTCATTCCCGAGCTGGGCATCTCAAACCTGCTTTCATCCAGCCATTG
TCTGAGACCACCTTCCTGCCTGCTGGATGCTCACAGTGACTGTGGATATGAGGGCTCCCCTTCTCC
CTTCAGCGACATGTCTTCTCCACTTGGTACAGACCACTCCTGGGAGGACACTTTTGCCAACGAACT
TTTCCCCCAGCTGATTAGTGTCTAAAGCCACCCACCACTGGGCTCCTTCCCTGATCATCACACTGC
CTAGAGGATAGCATAGGCCTGTCTGCTTCACTAAAAGCCAAAGTAGAGGCTATCTGGCCTTATAAG
AATTCCTCTAAAGTATTTCAAACCTCTTAGATGACTTCCAAGTATTGTCTTTTGACACTCAGCTGT
CTGAGGTCTTCAAAGGTATTCCAATACTACAGCTTTTGAGATTCTCATTATCTTAAAGGTGGTAGC
ATGCTCTAAATCATAGGGAAAGTCATCTGACAGTTATCGTTCAGCCTGGCTATGTAGCCGAGGCTA
AGCTGAAACTTGTGACCCTCTTGACCCCACTCCCAAGTGCTGGACTTTACCAGGTGTGCAGCTCCA
CACCGGCCTCTTCACATGTCCTGAAGTAGACATGAGAGTCACCAGTTCTTTCTCCTCCCCGCCC
CACAGGTTTCTTTTGTTTCCTTCTACAAGCAGAGAAACAGCAACCTGAGGGGCCTGTCCTTCCTTA
TGTCCAGTTCAAGTGAAGATCAAGAATCTTTGTAAAATTATTGGAAATTTACTGTGTAAATGCTTG
ATGGAATCTTCTTGCTAGTGTAGCTTCTAGAAGGTGCTTTCTCCATTTATTTAAAACTACCCATGC
AATTAAAAAAGCAACGCAGCATCCCCGTTGAATGATTTTAAAAAAAAAAAAAAAAAAAAAAAAAA
AAA
```

FIG. 5

```
GGCTGGGCGGCGGCGGCGGCGGCGCGCGGTGCGTAGTCTCGAGCTATGGTGGTGGTGGCAGCCGCAC
CGAGTCCGGCCGACGGGGCCCCTAAAGTACTGCTTCTGTCGGGGCAGCCCGCCTCCGCCGCCGGAGC
CCCGGCCGGCCAGGCCCTGCCGCTCATGGTGCCAGCCCAGAGAGGGGCTAGCCCGGAGGCAGCGAGC
GGGGGGCTGCCCCAGGCGCGCAAGCGGCAGCGCCTCACGCATCTGAGCCCCGAGGAGAAGGCGCTGA
GGAGGAAACTGAAAAACAGAGTAGCAGCTCAGACTGCCAGAGATCGAAAGAAAGCTCGAATGAGTGA
GCTGGAACAGCAAGTGGTAGATTTAGAAGAAGAGAACCAAAAACTTTTGCTAGAAAATCAGCTTTTA
CGAGAGAAAACTCACGGCCTTGTAGTTGAGAACCAGGAGTTAAGACAGCGCCTGGGGATGGATGCCC
TGGTTGCTAAAGAGGAGGCGGAAGCCAAGGGGAATGGAGTGAGGCCAGTGGCCGGGTCTGCTGAGTC
CGCAGTGCAGGCCCAGTTGTCACCCCTCCAGAACATCTCCCCATGGATTCTGGCGGTATTGACTCTT
CAGATTCAGAGTCTGATATCCTGTTGGGCATTCTGGACAACTTGGACCCAGTCATGTTCTTCAAATG
CCCTTCCCCAGAGTCTGCCAGCCTGGAGGAGCTCCCAGAGGTCTACCCAGAAGGACCCAGTTCCTTA
CCAGCCTCCCTTTCTCTGTCAGTGGGGACGTCATCAGCCAAGCTGGAAGCCATTAATGAACTAATTC
GTTTTGACCACATATATACCAAGCCCCTGGTCTTAGAGATACCCTCTGAGACAGAGAGCCAAGCTAA
TGTGGTAGTGAAAATCGAGGAAGCACCTCTCAGCCCCTCAGAGAATGATCACCCTGAATTCATTGTC
TCAGTGAAGGAAGAACCTGTAGAAGATGACCTCATTCCAGAGCTGGGTATCTCAAATCTGCTTTCAT
CCAGCCACTGCCCGAAACCATCTTCCTGCCTACTGGATGCTTACAGTGACTGTGGATATGGGGCTC
CCTTTCCCCCTTCAGTGACATGTCCTCTCCGCTTGGTGTAAACCATTCTTGGGAGGACACTTTTGCC
AATGAACTTTTTCCCCAGCTGATTAGTGTCTAAGGAATGATCCAGTACTGTTGCCCTTTTCCTTGAC
TATTACACTGCCTGGAGGATAGCAGGGAAGCCTGCCTGTGCTTCATTCAAAAAGCCAAAATAGAGAG
TACACAGTCCTAGAGAATTCCTTTCAAGTATTTGTTCAGATCTCATAGATGAGCCCCAGGTACTGTC
TTTTGACATCCAGCAGTCCAAAGTATTGAGACATATTACTGTAATTAAGAAATATTACTATAATTGA
GAACTACAGCTTTTAAGATTGTACTTTTATCTTAAAAGGGTGGTAGTTTGCCCTAAAATACTTATTA
TGTAAGGGTCATTAGACAAATGTCTTGAAGTAGAATTTATGAATGGTTCTTTATCATTTCTCTTCCC
CCTTTTTGGCATCCTGGCTTGCCTCCAGTTTTAGGTCCCTTAGTTTGCTTCTGTAAGCAAAGAGAAC
ACCTGCTGAGGGGCTCTTTCCCTCACGTATACTTCAAGTAAGATCAAGAATCTTTTGTGAAACTAT
AGAAATTTACTATGTAAATGCTTGATGGAATTTTTCCTGCTAGTGTAGCTTCTGAAAGGTGCTTTC
CATTTATTTAAAACTACCCATGCAATTAAAAGGTACAATGCAGCATCCTTGTTCTTTGATTTCTTCT
AGGGCCGTAAGTCTTATTTTCTCTCTAGTTGTTTCTGTGTGCTGTGGTAGGACTTTATCCAACTGAA
GTGAGCCTGCCACTTTTAAAAGTGACTGAAGGCTTTTCCACCTTAATTACTGCCTGCTTTAATTCTG
GATTGCCGTAAGTGATATAAGCTATAATTTGAGCAGTTACTATCTTTCTGAGACAGATTCTTGAGCC
TAACTGACCAATATCACAGCCAGTAAGTGGGAGAGCTAGAACCCTAACCACTATTTGCTATACGATC
TTATAAATGTTAAACAAGGACACACCATCACATATCAAGATTCTCTTGCCCTTATCATGGGAATTAA
GAGCATTTTCTAGACTCAAACTCCCTAGTTTCAACTCTGCCACTGGTAAGCTGGGTAACCCAGGGGT
TAT
```

COMPOSITIONS AND METHODS FOR INHIBITING EXPRESSION OF XBP-1 GENE

CROSS-REFERENCE TO RELATED APPLICATIONS

This application claims priority to U.S. application Ser. No. 61/045,947, filed Apr. 17, 2008; to U.S. Ser. No. 61/078,302, filed Jul. 3, 2008; to U.S. Ser. No. 61/081,861, filed Jul. 18, 2008. The entire contents of each of these provisional applications are hereby incorporated by reference in the present application.

FIELD OF THE INVENTION

The invention relates to a double-stranded ribonucleic acid (dsRNA) targeting X-Box Protein 1 (XBP-1), and methods of using the dsRNA to inhibit expression of XBP-1.

BACKGROUND OF THE INVENTION

X-box binding protein 1 (XBP-1) is a basic leucine zipper transcription factor that is involved in the cellular unfolded protein response (UPR). XBP-1 is known to be active in the endoplasmic reticulum (ER). The ER consists of a system of folded membranes and tubules in the cytoplasm of cells. Proteins and lipids are manufactured and processed in the ER. When unusual demands are placed on the ER, "ER stress" occurs. ER stress can be triggered by a viral infection, gene mutations, exposure to toxins, aggregation of improperly folded proteins or a shortage of intracellular nutrients. The result can be Type II diabetes, metabolic syndrome, a neurological disorder or cancer.

Two XBP-1 isoforms are known to exist in cells: spliced XBP-1S and unspliced XBP-1U. Both isoforms of XBP-1 bind to the 21-bp Tax-responsive element of the human T-lymphotropic virus type 1 (HTLV-1) long terminal repeat (LTR) in vitro and transactivate HTLV-1 transcription. HTLV-1 is associated with a rare form of blood dyscrasia known as Adult T-cell Leukemia/lymphoma (ATLL) and a myelopathy, tropical spastic paresis.

Double-stranded RNA molecules (dsRNA) have been shown to block gene expression in a highly conserved regulatory mechanism known as RNA interference (RNAi). WO 99/32619 (Fire et al.) disclosed the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.).

SUMMARY OF THE INVENTION

The invention provides compositions containing double-stranded ribonucleic acid (dsRNA) and methods for inhibiting the expression of an XBP-1 gene in a cell or mammal. The invention also provides compositions and methods for treating pathological conditions and diseases caused by the expression of XBP-1 gene, such as metabolic disorders (e.g., diabetes or metabolic syndrome), cardiovascular disease, protein folding diseases or cancer. The dsRNAs included in the compositions featured herein include a dsRNA having an RNA strand (the antisense strand) having a region which is less than 30 nucleotides in length, generally 19-24 nucleotides in length, and is substantially complementary to at least part of an mRNA transcript of the XBP-1 gene.

In one aspect, a dsRNA for inhibiting expression of an XBP-1 gene includes at least two sequences that are complementary to each other. The dsRNA includes a sense strand having a first sequence and an antisense strand having a second sequence. The antisense strand includes a nucleotide sequence that is substantially complementary to at least part of an mRNA encoding XBP-1, and the region of complementarity is less than 30 nucleotides in length, and at least 15 nucleotides in length. Generally, the dsRNA is 19 to 24, e.g., 19 to 21 nucleotides in length. In some embodiments the dsRNA is from about 10 to about 15 nucleotides in length, and in other embodiments the dsRNA is from about 25 to about 30 nucleotides in length. The dsRNA, upon contacting with a cell expressing XBP-1, inhibits the expression of an XBP-1 gene by at least 20%, at least 25%, at least 30%, at least 35% or at least 40%, such as when assayed by a method as described herein. In one embodiment, the Factor VII dsRNA is formulated in a stable nucleic acid particle (SNALP).

For example, the dsRNA molecules featured herein can include a first sequence of the dsRNA that is selected from the group consisting of the sense sequences of Tables 2, 4, 8, 9, 11 and 12 and a second sequence that is selected from the group consisting of the antisense sequences of Tables 2, 4, 8, 9, 11 and 12. The dsRNA molecules featured herein can include naturally occurring nucleotides or can include at least one modified nucleotide, such as a 2'-O-methyl modified nucleotide, a nucleotide having a 5'-phosphorothioate group, and a terminal nucleotide linked to a conjugate group, such as to a cholesteryl derivative, to vitamin E, or to a dodecanoic acid bisdecylamide group. Alternatively, the modified nucleotide may be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Generally, such modified sequence will be based on a first sequence of said dsRNA selected from the group consisting of the sense sequences of Tables 2, 4, 8, 9, 11 and 12 and a second sequence selected from the group consisting of the antisense sequences of Tables 2, 4, 8, 9, 11 and 12.

In one aspect, the invention provides a cell containing at least one of the dsRNAs featured in the invention. The cell is generally a mammalian cell, such as a human cell.

In another aspect, the invention provides a pharmaceutical composition for inhibiting the expression of an XBP-1 gene in an organism, generally a human subject. The composition typically includes one or more of the dsRNAs described herein and a pharmaceutically acceptable carrier or delivery vehicle. In one embodiment, the composition is used for treating cancer, e.g., a cancer of the liver.

In another aspect, the invention provides a method for inhibiting the expression of an XBP-1 gene in a cell by performing the following steps:

(a) introducing into the cell a double-stranded ribonucleic acid (dsRNA), wherein the dsRNA includes at least two sequences that are complementary to each other. The dsRNA has a sense strand comprising a first sequence and an antisense strand having a second sequence; the antisense strand has a region of complementarity that is substantially complementary to at least a part of a mRNA encoding XBP-1, and where the region of complementarity is less than 30 nucleotides in length, generally 19-24 nucleotides in length, and where the dsRNA, upon contact with a cell expressing the XBP-1, inhibits expression of the XBP-1 gene by at least 20%, at least 30%, or at least 40%; and (b) maintaining the cell produced in step (a) for a time sufficient to obtain degradation of the mRNA transcript of XBP-1 gene, thereby inhibiting expression of the XBP-1 gene in the cell.

In one embodiment, the method is for inhibiting gene expression in a cell infected with HTLV-1, such as a tumor cell.

In another aspect, the invention provides methods for treating, preventing or managing pathological processes mediated by XBP-1 expression, e.g., a metabolic disease such as diabetes (e.g., Type II diabetes or metabolic syndrome), or cardiovascular disease. The method can include administering to a patient in need of such treatment, prevention or management a therapeutically or prophylactically effective amount of one or more of the dsRNAs featured in the invention. In one embodiment the patient has metabolic syndrome. For example, a patient with metabolic syndrome can have one of more of high cholesterol, obesity, and/or insulin insensitivity. In some embodiments, a patient with metabolic syndrome will also have heart disease. In another embodiment, the patient has a dyslipidemia or a disorder associated with a dyslipidemia. For example, in one embodiment the patient has atherosclerosis, which is often associated with hypercholesterolemia. In another embodiment, the patient has cancer or a neurological disorder. In yet another embodiment, the patient (e.g., a human patient) is infected with a retrovirus, such as HTLV-1. In another embodiment, the patient has a disorder or condition caused by the HTVL-1, such as a myelopathy, e.g., tropical spastic paresis. In one embodiment, administration of the dsRNA targeting XBP-1 alleviates or relieves the severity of at least one symptom of the XBP-1 mediated disorder in the patient.

In another embodiment, the invention provides a vector for inhibiting the expression of an XBP-1 gene in a cell. In one embodiment, the vector includes at least one regulatory sequence operably linked to a nucleotide sequence that encodes at least one strand of one of a dsRNA featured in the invention.

In another embodiment, the invention provides a cell containing a vector for inhibiting the expression of an XBP-1 gene in a cell. The vector includes a regulatory sequence operably linked to a nucleotide sequence that encodes at least one strand of one of the dsRNA featured in the invention.

In a further embodiment, the invention provides a composition containing an XBP-1 dsRNA, in combination with a second dsRNA targeting a second gene involved in a pathological disease, and useful for treating the disease, e.g., diabetes or cardiovascular disease.

BRIEF DESCRIPTION OF THE DRAWINGS

FIG. 2 is the sequence of human XBP-1 mRNA as recorded at RefSeq No. NM_005080.2 (GI Ref. No. 14110394) (SEQ ID NO:4331).

FIG. 3 is the sequence of mouse XBP-1 mRNA as recorded at RefSeq No. NM_013842.2 (GI Ref. No. 13775155) (SEQ ID NO:4332). The underlined sequence is the target of siRNA AD18038.

FIG. 4 is the sequence of rat XBP-1 mRNA as recorded at RefSeq No. NM_001004210.1 (GI Ref. No. 51948391) (SEQ ID NO:4333).

FIG. 5 is the sequence of rhesus XBP-1 as recorded at RefSeq No. XM_001103095.1 (GI Ref. No. 109093732) (SEQ ID NO:4334).

DETAILED DESCRIPTION OF THE INVENTION

Figure 1A:
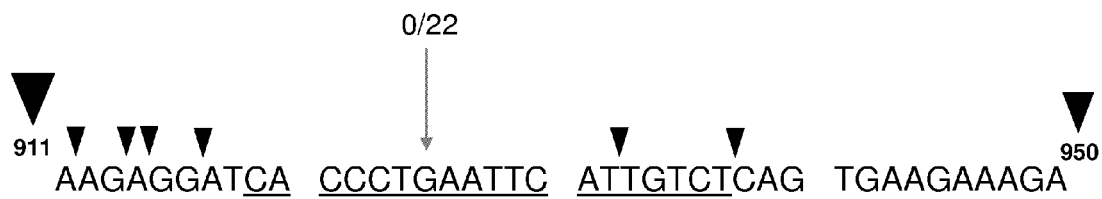
FIGS. 1A and 1B represent the sequence of the XBP-1 5' RACE product around the target sequence of the siRNA AD18038. The intended cleavage site of the siRNA is indicated by a vertical arrow above the sequence. The cleavage sites due to degradation of the 5' RACE product in mice are indicated by arrowheads above the sequence. "0/22" is the number of cleavage events what were observed at the expected XBP-1 siRNA cleavage site in the sample group of negative control mice, which were treated with siRNA LNP01-1955 or PBS (FIG. 1A; SEQ ID NO:4329). "26/34" is the number of cleavage events that were observed at the expected siRNA cleavage site in the sample group of mice treated with the XBP-1 siRNA AD18038 (FIG. 1B; SEQ ID NO:4330). The underlined sequence is the target of the XBP-1 siRNA AD18038.

The invention provides dsRNAs and methods of using the dsRNAs for inhibiting the expression of an XBP-1 gene in a cell or a mammal where the dsRNA targets the XBP-1 gene. The invention also provides compositions and methods for treating pathological conditions and diseases, such as a metabolic disease or a cardiovascular disease, in a mammal caused by the expression of the XBP-1 gene. dsRNA directs the sequence-specific degradation of mRNA through a process known as RNA interference (RNAi).

The dsRNAs of the compositions featured herein include an RNA strand (the antisense strand) having a region which is less than 30 nucleotides in length, generally 19-24 nucleotides in length, and is substantially complementary to at least part of an mRNA transcript of the XBP-1 gene. The use of these dsRNAs enables the targeted degradation of mRNAs of genes that are implicated in replication and or maintenance of cancer cells in mammals. Very low dosages of XBP-1 dsRNAs in particular can specifically and efficiently mediate RNAi, resulting in significant inhibition of expression of the XBP-1 gene. The methods and compositions containing the XBP-1 dsRNA are useful for treating pathological processes mediated by XBP-1 expression, e.g., a metabolic disease or cardiovascular disease.

The following detailed description discloses how to make and use the compositions containing dsRNAs to inhibit the expression of the XBP-1 gene, as well as compositions and methods for treating diseases and disorders caused by the expression of these genes, such as leukemia. The pharmaceutical compositions featured in the invention include a dsRNA having an antisense strand comprising a region of complementarity which is less than 30 nucleotides in length, generally 19-24 nucleotides in length, and is substantially complementary to at least part of an RNA transcript of the XBP-1 gene, together with a pharmaceutically acceptable carrier. The compositions featured in the invention also include a dsRNA having an antisense strand having a region of complementarity which is less than 30 nucleotides in length, generally 19-24 nucleotides in length, and is substantially complementary to at least part of an RNA transcript of the XBP-1 gene.

Accordingly, in some aspects, pharmaceutical compositions containing the XBP-1 dsRNA and a pharmaceutically acceptable carrier, methods of using the compositions to inhibit expression of the XBP-1 gene, and methods of using the pharmaceutical compositions to treat diseases caused by expression of the XBP-1 gene are featured in the invention.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, thymidine and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the invention by a nucleotide containing, for example, inosine. In another example, adenine and cytosine anywhere in the oligonucleotide can be replaced with guanine and uracil, respectively to form G:U Wobble base pairing with the target mRNA. Sequences containing such replacement moieties are suitable for the compositions and methods featured the invention.

As used herein, "XBP-1" refers to X-Box Protein 1, which is also known as Tax-responsive element-binding protein 5, TREB5, and XBP2. XBP-1 sequence can be found as NCBI GeneID:7494 and RefSeq ID number:NM_005080 (human) (FIG. 1) and NM_013842 (mouse, FIG. 2). A dsRNA featured in the invention can target a specific XBP-1 isoform, e.g., the spliced form (XBP-1S) or the unspliced form (XBP-1U), or a dsRNA featured in the invention can target both isoforms by binding to a common region of the mRNA transcript.

As used herein, "target sequence" refers to a contiguous portion of the nucleotide sequence of an mRNA molecule formed during the transcription of the XBP-1 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding XBP-1). For example, a polynucleotide is complementary to at least a part of an XBP-1 mRNA if the sequence is substantially complementary to a non-interrupted portion of an mRNA encoding XBP-1.

The term "double-stranded RNA" or "dsRNA," as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop." Where the two strands are connected covalently by means other than an uninterrupted chain of nucleotides between the 3'-end of one strand and the 5' end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. For example, a dsRNA can have a dinucleotide overhang at the 3' end at one or both of the sense or antisense strands, such as a dTdT (deoxythymidine-deoxythymidine) or a dTsdT (deoxythymidine-(thiophosphate linker)-deoxythymidine) dinucleotide overhang at one or both of the 3' ends of the sense or antisense strands.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

The term "identity" is the relationship between two or more polynucleotide sequences, as determined by comparing the sequences. Identity also means the degree of sequence relatedness between polynucleotide sequences, as determined by the match between strings of such sequences. While there exist a number of methods to measure identity between two polynucleotide sequences, the term is well known to skilled artisans (see, e.g., Sequence Analysis in Molecular Biology, von Heinje, G., Academic Press (1987); and Sequence Analysis Primer, Gribskov., M. and Devereux, J., eds., M. Stockton Press, New York (1991)). "Substantially identical," as used herein, means there is a very high degree of homology (e.g., 100% sequence identity) between the sense strand of the dsRNA and the corresponding part of the target gene. However, dsRNA having greater than 90%, or 95% sequence identity may be used in the present invention, and thus sequence variations that might be expected due to genetic mutation, strain polymorphism, or evolutionary divergence can be tolerated. The dsRNA is typically 100% complementary to the target RNA, but in some embodiments, the dsRNA may contain single or multiple base-pair random mismatches between the RNA and the target gene.

As used herein, the term "SNALP" refers to a stable nucleic acid-lipid particle. A SNALP represents a vesicle of lipids coating a reduced aqueous interior comprising a nucleic acid such as an iRNA agent or a plasmid from which an iRNA agent is transcribed. SNALPs are described, e.g., in U.S. Patent Application Publication Nos. 20060240093, 20070135372, and U.S. Ser. No. 61/045,228 filed Apr. 15, 2008. These applications are hereby incorporated by reference.

"Introducing into a cell," when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell," wherein the cell is part of a living organism. In such instance, introduction into the cell will include the delivery to the organism. For example, for in vivo delivery, dsRNA can be injected into a tissue site or administered systemically. In vivo delivery can also be by a beta-glucan delivery system, such as those described in U.S. Pat. Nos. 5,032,401 and 5,607,677, and U.S. Publication No. 2005/0281781. U.S. Pat. Nos. 5,032,401 and 5,607,677, and U.S. Publication No. 2005/0281781 are hereby incorporated by reference in their entirety. In vitro introduction into a cell includes methods known in the art such as electroporation and lipofection.

The terms "silence," "inhibit the expression of," "down-regulate the expression of," "suppress the expression of," and the like, in as far as they refer to the XBP-1 gene, herein refer to the at least partial suppression of the expression of the XBP-1 gene, as manifested by a reduction of the amount of XBP-1 mRNA which may be isolated from a first cell or group of cells in which the XBP-1 gene is transcribed and which has or have been treated such that the expression of the XBP-1 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to XBP-1 gene expression, e.g., the amount of protein encoded by the XBP-1 gene which is secreted by a cell, or the number of cells displaying a certain phenotype, e.g., apoptosis. In principle, XBP-1 gene silencing may be determined in any cell expressing XBP-1, either constitutively or by genomic engineering, and by any appropriate assay. However, when a reference is needed in order to determine whether a given dsRNA inhibits the expression of the XBP-1 gene by a certain degree and therefore is encompassed by the instant invention, the assay provided in the Examples below shall serve as such reference.

For example, in certain instances, expression of the XBP-1 gene is suppressed by at least about 20%, 25%, 30%, 35%, 40%, 45%, or 50% by administration of the double-stranded oligonucleotide featured in the invention. In some embodiments, the XBP-1 gene is suppressed by at least about 60%, 70%, or 80% by administration of the double-stranded oligonucleotide featured in the invention. In some embodiments, the XBP-1 gene is suppressed by at least about 85%, 90%, or 95% by administration of the double-stranded oligonucleotide featured in the invention.

As used herein in the context of XBP-1 expression, the terms "treat," "treatment," and the like, refer to relief from or alleviation of pathological processes mediated by XBP-1 expression. In the context of the present invention insofar as it relates to any of the other conditions recited herein below (other than pathological processes mediated by XBP-1 expression), the terms "treat," "treatment," and the like mean to relieve or alleviate at least one symptom associated with such condition, or to slow or reverse the progression of such condition, such as the slowing and progression of hepatic carcinoma.

As used herein, the phrases "therapeutically effective amount" and "prophylactically effective amount" refer to an amount that provides a therapeutic benefit in the treatment, prevention, or management of pathological processes mediated by XBP-1 expression or an overt symptom of pathological processes mediated by XBP-1 expression. The specific amount that is therapeutically effective can be readily determined by an ordinary medical practitioner, and may vary depending on factors known in the art, such as, e.g., the type of pathological processes mediated by XBP-1 expression, the patient's history and age, the stage of pathological processes mediated by XBP-1 expression, and the administration of other anti-pathological processes mediated by XBP-1 expression agents.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

II. Double-Stranded Ribonucleic Acid (dsRNA)

In one embodiment, the invention provides double-stranded ribonucleic acid (dsRNA) molecules for inhibiting the expression of an XBP-1 gene in a cell or mammal, e.g., in a human having a metabolic disease, such as diabetes, or cardiovascular disease, where the dsRNA includes an antisense strand having a region of complementarity which is complementary to at least a part of an mRNA formed in the expression of the XBP-1 gene, and where the region of complementarity is less than 30 nucleotides in length, generally 19-24 nucleotides in length, and where said dsRNA, upon contact with a cell expressing said XBP-1 gene, inhibits the expression of said XBP-1 gene by at least 30% as assayed by, for example, a PCR or branched DNA (bDNA) based method. The dsRNA includes two RNA strands that are sufficiently complementary to hybridize to form a duplex structure. One strand of the dsRNA (the antisense strand) includes a region of complementarity that is substantially complementary, and generally fully complementary, to a target sequence, derived from the sequence of an mRNA formed during the expression of the XBP-1 gene, the other strand (the sense strand) includes a region that is complementary to the antisense strand, such that the two strands hybridize and form a duplex structure when combined under suitable conditions. Generally, the duplex structure is between 15 and 30, more generally between 18 and 25, yet more generally between 19 and 24, and most generally between 19 and 21 base pairs in length. Similarly, the region of complementarity to the target sequence is between 15 and 30, more generally between 18 and 25, yet more generally between 19 and 24, and most generally between 19 and 21 nucleotides in length. In some embodiments, the dsRNA is between 10 and 15 nucleotides in length, and in other embodiments, the dsRNA is between 25 and 30 nucleotides in length. The dsRNA featured in the invention may further include one or more single-stranded nucleotide overhangs.

The dsRNA can be synthesized by standard methods known in the art as further discussed below, e.g., by use of an automated DNA synthesizer, such as are commercially available from, for example, Biosearch, Applied Biosystems, Inc. In one embodiment, the XBP-1 gene is the human XBP-1 gene. In specific embodiments, the first sequence is selected from the group consisting of the sense sequences of Tables 2, 4, 8, 9, 11 and 12, and the second sequence is selected from the group consisting of the antisense sequences of Tables 2, 4, 8, 9, 11 and 12. Alternative antisense agents that target elsewhere in the target sequence provided in Tables 2, 4, 8, 9, 11 and 12 can readily be determined using the target sequence and the flanking XBP-1 sequence.

The dsRNA will include at least two nucleotide sequence selected from the groups of sequences provided in Tables 2, 4, 8, 9, 11 and 12. One of the two sequences is complementary to the other of the two sequences, with one of the sequences being substantially complementary to a sequence of an mRNA generated in the expression of the XBP-1 gene. As such, the dsRNA will include two oligonucleotides, where one oligonucleotide is described as the sense strand in Tables 2, 4, 8, 9, 11 and 12 and the second oligonucleotide is described as the antisense strand in Tables 2, 4, 8, 9, 11 and 12.

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Tables 2, 4, 8, 9, 11 and 12, the dsRNAs featured in the invention can include at least one strand of a length of minimally 21 nt. It can be reasonably expected that shorter dsRNAs having one of the sequences of Tables 2, 4, 8, 9, 11 and 12 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Tables 2, 4, 8, 9, 11 and 12, and differing in their ability to inhibit the expression of the XBP-1 gene in a FACS assay as described herein below by not more than 5, 10, 15, 20, 25, or 30% inhibition from a dsRNA comprising the full sequence, are contemplated by the invention. Further, dsRNAs that cleave within a desired XBP-1 target sequence can readily be made using the corresponding XBP-1 antisense sequence and a complementary sense sequence.

In addition, the dsRNAs provided in 2, 4, 8, 9, 11 and 12 identify a site in the XBP-1 mRNA that is susceptible to RNAi based cleavage. As such the present invention further features dsRNAs that target within the sequence targeted by one of the agents of the present invention. As used herein a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Tables 2, 4, 8, 9, 11 and 12 coupled to additional nucleotide sequences taken from the region contiguous to the selected sequence in the XBP-1 gene. For example, the last 15 nucleotides of SEQ ID NO:1 combined with the next six nucleotides from the target XBP-1 gene produces a single strand agent of 21 nucleotides that is based on one of the sequences provided in Tables 2, 4, 8, 9, 11 and 12.

The dsRNA featured in the invention can contain one or more mismatches to the target sequence. In one embodiment, the dsRNA featured the invention contains no more than 3 mismatches. If the antisense strand of the dsRNA contains mismatches to a target sequence, it the area of mismatch is typically not located in the center of the region of complementarity. If the antisense strand of the dsRNA contains mismatches to the target sequence, the mismatch is typically restricted to 5 nucleotides from either end, for example 5, 4, 3, 2, or 1 nucleotide from either the 5' or 3' end of the region of complementarity. For example, for a 23 nucleotide dsRNA strand which is complementary to a region of the XBP-1 gene, the dsRNA generally does not contain any mismatch within the central 13 nucleotides. The methods described within the invention can be used to determine whether a dsRNA containing a mismatch to a target sequence is effective in inhibiting the expression of the XBP-1 gene. Consideration of the efficacy of dsRNAs with mismatches in inhibiting expression of the XBP-1 gene is important, especially if the particular region of complementarity in the XBP-1 gene is known to have polymorphic sequence variation within the population.

In one embodiment, at least one end of the dsRNA has a single-stranded nucleotide overhang of 1 to 4, generally 1 or 2 nucleotides. dsRNAs having at least one nucleotide overhang have unexpectedly superior inhibitory properties than their blunt-ended counterparts. Moreover, the present inventors have discovered that the presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. In one embodiment, the antisense strand of the dsRNA has a 1-10 nucleotide overhang at the 3' end and/or the 5' end. In one embodiment, the sense strand of the dsRNA has a 1-10 nucleotide overhang at the 3' end and/or the 5' end. In another embodiment, one or more of the nucleotides in the overhang is replaced with a nucleoside thiophosphate.

In yet another embodiment, the dsRNA is chemically modified to enhance stability. The nucleic acids featured in the invention may be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Specific examples of dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Modified dsRNA backbones that do not include a phosphorus atom therein have backbones that are formed by short chain alkyl or cycloalkyl internucleoside linkages, mixed heteroatoms and alkyl or cycloalkyl internucleoside linkages, or ore or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other suitable dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, an dsRNA mimetic that has been shown to have excellent hybridization properties, is referred to as a peptide nucleic acid (PNA). In PNA compounds, the sugar backbone of an dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

Most embodiments featured in the invention include dsRNAs with phosphorothioate backbones and oligonucleosides with heteroatom backbones, and in particular —CH$_2$—NH—CH$_2$—, —CH$_2$—N(CH$_3$)—O—CH$_2$— [known as a methylene (methylimino) or MMI backbone], —CH$_2$—O—N(CH$_3$)—CH$_2$—, —CH$_2$—N(CH$_3$)—N(CH$_3$)—CH$_2$— and —N(CH$_3$)—CH$_2$—CH$_2$— [wherein the native phosphodiester backbone is represented as —O—P—O—CH$_2$—] of the above-referenced U.S. Pat. No. 5,489,677, and the amide backbones of the above-referenced U.S. Pat. No. 5,602,240. In some embodiments, the dsRNAs featured herein have morpholino backbone structures of the above-referenced U.S. Pat. No. 5,034,506.

Modified dsRNAs may also contain one or more substituted sugar moieties. The dsRNAs featured herein can one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C$_1$ to C$_{10}$ alkyl or C$_2$ to C$_{10}$ alkenyl and alkynyl. Typical modifications are O[(CH$_2$)$_n$O]$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]$_2$, where n and m are from 1 to about 10. In other embodiments, dsRNAs include one of the following at the 2' position: C$_1$ to C$_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., Helv. Chim. Acta, 1995, 78:486-504) i.e., an alkoxy-alkoxy group. Other typical modification include 2'-dimethylaminooxyethoxy, i.e., a O(CH$_2$)$_2$ON(CH$_3$)$_2$ group, also known as 2'-DMAOE, as described in examples hereinbelow, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$, also described in examples hereinbelow.

Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

DsRNAs may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., DsRNA Research and Applications, CRC Press, Boca Raton, 1993, pp. 276-278) and are typical base substitutions, particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; and 5,681,941, each of which is herein incorporated by reference, and U.S. Pat. No. 5,750,692, also herein incorporated by reference.

Another modification of the dsRNAs featured in the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acid. Sci. USA, 199, 86, 6553-6556), cholic acid (Manoharan et al., Biorg. Med. Chem. Let., 1994 4 1053-1060), a thioether, e.g., beryl-5-tritylthiol (Manoharan et al., Ann. N.Y. Acad. Sci., 1992, 660, 306-309; Manoharan et al., Biorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J, 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyloxycholesterol moiety (Crooke et al., J. Pharmacol. Exp. Ther., 1996, 277, 923-937).

Representative U.S. patents that teach the preparation of such dsRNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584;

5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of an dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxydsRNAs hybridizing to the same target region. Cleavage of the RNA target can be routinely detected by gel electrophoresis and, if necessary, associated nucleic acid hybridization techniques known in the art.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

Vector Encoded dsRNAs

In another aspect, XBP-1 specific dsRNA molecules are expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., Proc. Natl. Acad. Sci. USA (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In one embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., Curr. Topics Micro. Immunol. (1992) 158:97-129)); adenovirus (see, for example, Berkner, et al., BioTechniques (1998) 6:616), Rosenfeld et al. (1991, Science 252:431-434), and Rosenfeld et al. (1992), Cell 68:143-155)); or alphavirus as well as others known in the art. Retroviruses have been used to introduce a variety of genes into many different cell types, including epithelial cells, in vitro and/or in vivo (see, e.g., Eglitis, et al., Science (1985) 230:1395-1398; Danos and Mulligan, Proc. Natl. Acad. Sci. USA (1998) 85:6460-6464; Wilson et al., 1988, Proc. Natl. Acad. Sci. USA 85:3014-3018; Armentano et al., 1990, Proc. Natl. Acad. Sci. USA 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beusechem. et al., 1992, Proc. Nad. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors featured in the invention can be pseudotyped with surface proteins from vesicular stomatitis virus (VSV), rabies, Ebola, Mokola, and the like. AAV vectors featured in the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Viral vectors can be derived from AV and AAV. In one embodiment, the dsRNA featured in the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA featured in the invention, a method for constructing the recombinant AV vector, and a method for delivering the vector into target cells, are described in Xia H et al. (2002), *Nat. Biotech.* 20: 1006-1010.

Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

The promoter driving dsRNA expression in either a DNA plasmid or viral vector featured in the invention may be a eukaryotic RNA polymerase I (e.g., ribosomal RNA promoter), RNA polymerase II (e.g., CMV early promoter or actin promoter or U1 snRNA promoter) or generally RNA polymerase III promoter (e.g., U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g., Oligofectamine) or non-cationic lipid-based carriers (e.g., Transit-TKO™). Multiple lipid transfections for dsRNA-mediated knockdowns targeting different regions of a single XBP-1 gene or multiple XBP-1 genes over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

The XBP-1 specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Comprising dsRNA

In one embodiment, the invention provides pharmaceutical compositions comprising a dsRNA, as described herein, and a pharmaceutically acceptable carrier. The pharmaceutical composition comprising the dsRNA is useful for treating a disease or disorder associated with the expression or activity of the XBP-1 gene, such as pathological processes mediated by XBP-1 expression. Such pharmaceutical compositions are formulated based on the mode of delivery. One example is compositions that are formulated for systemic administration via parenteral delivery.

The pharmaceutical compositions featured herein are administered in dosages sufficient to inhibit expression of the XBP-1 genes. In general, a suitable dose of total dsRNA will be in the range of 0.01 to 200.0 milligrams per kilogram body weight of the recipient per day, generally in the range of 0.02 to 50 mg per kilogram body weight per day. For example, the dsRNA can be administered at 0.01 mg/kg, 0.1 mg/kg, 0.05 mg/kg, 0.5 mg/kg, 1 mg/kg, 2 mg/kg, 3 mg/kg, 5 mg/kg, 10 mg/kg, 20 mg/kg, 30 mg/kg, 40 mg/kg, or 50 mg/kg per single dose. The pharmaceutical composition may be administered once daily or the dsRNA may be administered as two, three, or more sub-doses at appropriate intervals throughout the day or even using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by XBP-1 expression. Such models are used for in vivo testing of dsRNA, as well as for determining a therapeutically effective dose.

The present invention also includes pharmaceutical compositions and formulations which include the dsRNA compounds featured in the invention. The pharmaceutical compositions of the present invention may be administered in a number of ways depending upon whether local or systemic treatment is desired and upon the area to be treated. Administration may be topical (e.g., by a transdermal patch), pulmonary (e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; subdermal, e.g., via an implanted device; or intracranial, e.g., by intrathecal or intraventricular, administration.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the dsRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). DsRNAs featured in the invention may be encapsulated within liposomes or may form complexes thereto, in particular to cationic liposomes. Alternatively, dsRNAs may be complexed to lipids, in particular to cationic lipids. Suitable fatty acids and esters include but are not limited arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g., isopropylmyristate IPM), monoglyceride, diglyceride or pharmaceutically acceptable salt thereof. Topical formulations are described in detail in U.S. patent application Ser. No. 09/315, 298 filed on May 20, 1999 which is incorporated herein by reference in its entirety.

In one embodiment, a dsRNA featured in the invention is fully encapsulated in the lipid formulation (e.g., to form a SPLP, pSPLP, SNALP, or other nucleic acid-lipid particle). As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-

Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA), or a mixture thereof. The cationic lipid may comprise from about 20 mol % to about 50 mol % or about 40 mol % of the total lipid present in the particle.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{i2}$), a PEG-dimyristyloxypropyl ($C_{i4}$), a PEG-dipalmityloxypropyl ($C_{i6}$), or a PEG-distearyloxypropyl ($C_{i8}$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (Formula 1), Cholesterol (Sigma-Aldrich), and PEG-Ceramide C16 (Avanti Polar Lipids) can be used to prepare lipid-siRNA nanoparticles (i.e., LNP01 particles). Stock solutions of each in ethanol can be prepared as follows: ND98, 133 mg/mL; Cholesterol, 25 mg/mL, PEG-Ceramide C16, 100 mg/mL. The ND98, Cholesterol, and PEG-Ceramide C16 stock solutions can then be combined in a, e.g., 42:48:10 molar ratio. The combined lipid solution can be mixed with aqueous siRNA (e.g., in sodium acetate pH 5) such that the final ethanol concentration is about 35-45% and the final sodium acetate concentration is about 100-300 mM. Lipid-siRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

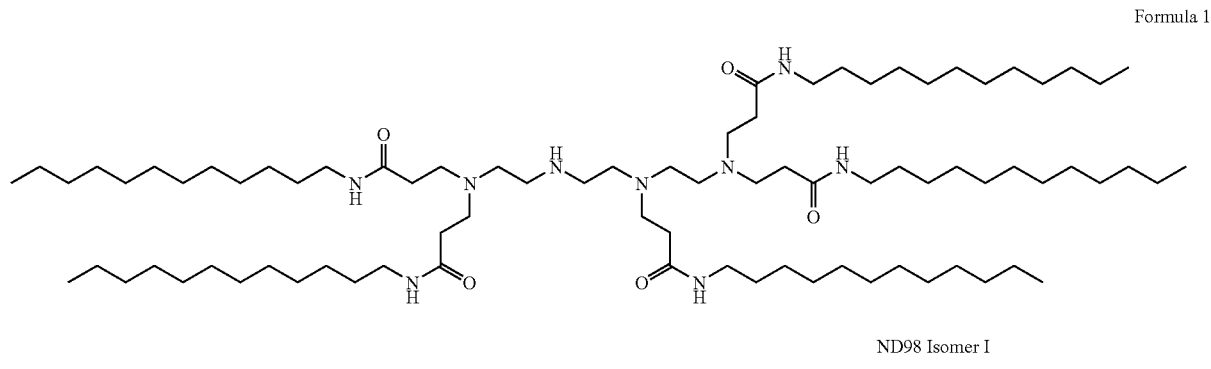

Formula 1

ND98 Isomer I

LNP01 formulations are described, e.g., in International Application Publication No. WO 2008/042973, which is hereby incorporated by reference.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm.

The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. application. Ser. No. 08/886,829 (filed Jul. 1, 1997), Ser. No. 09/108,673 (filed Jul. 1, 1998), Ser. No. 09/256,515 (filed Feb. 23, 1999), Ser. No. 09/082,624 (filed May 21, 1998) and Ser. No. 09/315,298 (filed May 20, 1999), each of which is incorporated herein by reference in their entirety.

Compositions and formulations for parenteral, intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Emulsions

The compositions of the present invention may be prepared and formulated as emulsions. Emulsions are typically heterogenous systems of one liquid dispersed in another in the form of droplets usually exceeding 0.1.mu·m in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Liposomes

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome.™. I (glyceryl dilaurate/cholesterol/po-lyoxyethylene-10-stearyl ether) and Novasome.™. II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $GM_1$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $GM_1$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $GM_1$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{12}15G$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A limited number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include an dsRNA RNA. U.S. Pat. No. 5,665,710 to Rahman et al. describes certain methods of encapsulating oligodeoxynucleotides in liposomes. WO 97/04787 to Love et al. discloses liposomes comprising dsRNA dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines) (Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclicureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipient suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

In some embodiments, pharmaceutical compositions featured in the invention include (a) one or more dsRNA compounds and (b) one or more other chemotherapeutic agents which function by a non-RNAi mechanism. Examples of such chemotherapeutic agents include but are not limited to daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphor-amide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). See, generally, The Merck Manual of Diagnosis and Therapy, 15th Ed.

1987, pp. 1206-1228, Berkow et al., eds., Rahway, N.J. When used with the dsRNAs featured in the invention, such chemotherapeutic agents may be used individually (e.g., 5-FU and oligonucleotide), sequentially (e.g., 5-FU and oligonucleotide for a period of time followed by MTX and oligonucleotide), or in combination with one or more other such chemotherapeutic agents (e.g., 5-FU, MTX and oligonucleotide, or 5-FU, radiotherapy and oligonucleotide). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions featured in the invention. See, generally, The Merck Manual of Diagnosis and Therapy, 15th Ed., Berkow et al., eds., 1987, Rahway, N.J., pages 2499-2506 and 46-49, respectively). Other non-RNAi chemotherapeutic agents are also within the scope of this invention. Two or more combined compounds may be used together or sequentially.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are typical.

The data obtained from cell culture assays and animal studies can be used in formulation a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by XBP-1 expression. In any event, the administering physician can adjust the amount and timing of dsRNA administration on the basis of results observed using standard measures of efficacy known in the art or described herein.

Methods for Treating Diseases Caused by Expression of the XBP-1 Gene

The invention relates in particular to the use of a dsRNA targeting XBP-1 and compositions containing at least one such dsRNA, for the treatment of an XBP-1-mediated disorder or disease. For example, a dsRNA targeting an XBP-1 gene can be useful for the treatment of a metabolic disease, such as Type II diabetes and metabolic syndrome, or a cardiovascular disease. "Metabolic syndrome" (also called metabolic syndrome X, X syndrome, insulin resistance syndrome, Reaven's syndrome, and CHAOS) is characterized by a group of metabolic risk factors including: abdominal obesity (excessive fat tissue in and around the abdomen), atherogenic dyslipidemia (blood fat disorders (including high triglycerides, low HDL cholesterol and high LDL cholesterol) that foster plaque build-up in artery walls), elevated blood pressure, insulin resistance or glucose intolerance (due to the body's inability to properly use insulin or blood sugar), a prothrombotic state (e.g., high fibrinogen or plasminogen activator inhibitor-1 in the blood), and a proinflammatory state (e.g., elevated C-reactive protein in the blood). People with metabolic syndrome are at increased risk of coronary heart disease and other diseases related to plaque buildups in artery walls (e.g., stroke and peripheral vascular disease), and Type II diabetes. A "cardiovascular disease," as used herein is a disorder that affects the heart or blood vessels, such as atherosclerosis, coronary artery disease, high blood pressure, congenital heart disease, aneurysm, a heart valve disease, a heart infection, or cardiomyopathy. Other metabolic diseases suitable for treatment with a dsRNA targeting XBP-1 include obesity and insulin resistance.

A dsRNA targeting XBP-1 is also useful for the treatment of a dyslipidemia, such as a hyperlidipemia (e.g., hypercholesterolemia), or a disorder associated with a dyslipidemia, such as atherosclerosis. A "hyperlipidemia" refers to elevated lipid levels in the blood (e.g., in plasma), such as elevated levels of one or more of cholesterol, LDL (low density lipoprotein), VLDL (very low density lipoprotein), triglycerides, or chylomicrons.

A dsRNA targeting XBP-1 is also useful for the treatment of liver disorders, such as a nonalcoholic fatty liver disease (NAFLD), which is a fatty inflammation of the liver not due to excessive use of alcohol, or cirrhosis. For example, a dsRNA targeting XBP-1 can be used to treat non-alcoholic steatohepatitis (NASH), which is one of the most extreme forms of NAFLD, and which is regarded as a major cause of cirrhosis of the liver of unknown cause.

A dsRNA targeting XBP-1 can also be useful for the treatment of cancer, such as a leukemia, e.g., ATLL. A dsRNA targeting XBP-1 can also be used to treat a myelopathy, e.g., tropical spastic paresis (TSP). TSP is a chronic and progressive disease of the nervous system that typically affects adults living in equatorial areas of the world and can cause progressive weakness, stiff muscles, muscle spasms, sensory disturbance, and sphincter dysfunction. A "myelopathy," as used herein, is a neurological deficit related to the spinal cord.

A composition containing a dsRNA targeting XBP-1 may also be used to treat other tumors and cancers, such as breast cancer, lung cancer, head and neck cancer, brain cancer, abdominal cancer, colon cancer, colorectal cancer, esophagus cancer, gastrointestinal cancer, glioma, tongue cancer, neuroblastoma, osteosarcoma, ovarian cancer, pancreatic cancer, prostate cancer, retinoblastoma, Wilm's tumor, multiple myeloma and for the treatment of skin cancer, like melanoma, for the treatment of lymphomas and blood cancer.

Owing to the inhibitory effects on XBP-1 expression, a composition according to the invention or a pharmaceutical composition prepared therefrom can enhance the quality of life.

The invention further relates to the use of a dsRNA or a pharmaceutical composition thereof, e.g., for treating a metabolic disorder, cardiovascular disease, or an HTLV-1 mediated disorder, in combination with other pharmaceuticals and/or other therapeutic methods, e.g., with known pharmaceuticals and/or known therapeutic methods, such as, for example, those which are currently employed for treating these disorder. In one example, administration of a dsRNA targeting XBP-1 can be accompanied by a exercise regimen or by dietary restrictions. A dsRNA featured in the invention can also be administered with a drug or combination of drugs for managing Type II diabetes, e.g., a sulfonylurea, a biguanide, an alpha-glucosidase inhibitor, a thiazolidinedione (e.g., rosiglitazone or pioglitazone), a meglitinide, a D-phenylalanine derivative, an amylin synthetic derivatives, an incretin mimetic, metformin, or an insulin. Exemplary insulins include regular insulins (Humulin®, Novolin®), insulin lispro (Humalog®), insulin aspart (Novolog®), insulin glulisine (Apidra®), prompt insulin zinc (Semilente®, slightly slower acting), inhaled insulin (Exubera®), intermediate-acting insulins, isophane insulin, neutral protamine Hagedorn (NPH), insulin zinc (Lente®), extended insulin zinc insulin (Ultralente®), insulin glargine (Lantus®), and insulin detemir (Levemir®).

In another example, a composition containing a dsRNA targeting XBP-1 is administered in combination with a lipid-lowering drug, such as a statin, e.g., atorvastatin (Lipitor®) or simvastatin (Mevacor®); ezetimibe (Zetia®); a bile-acid sequestrant, such as Questran®; a fibrate, such as gemfibrozil (Lopid®) or fenofibrate (Tricor); or a compound that raises HDL levels, such as nicotinic acid (Niacin).

A dsRNA targeting XBP-1 can also be provided in combination with a vitamin, such as vitamin E or vitamin C, e.g., for treatment of a liver disorder, such as NAFLD or NASH.

In another example, a composition containing a dsRNA targeting XBP-1 is administered in combination with an anti-viral drug, such as zidovudine, ribivirin, vidarabine, acyclovir and ganciclovir, or an anti-inflammatory drug, such as a non-steroidal anti-inflammatory drugs or corticosteroid. See, generally, The Merck Manual of Diagnosis and Therapy, 15th Ed., Berkow et al., eds., 1987, Rahway, N.J., pages 2499-2506 and 46-49, respectively). Administration can also be in combination with an interferon, such as interferon alpha or interferon beta; lioresal, tizanidine, or oxybutynin.

In certain embodiments, administration is with a chemotherapy agent, such as deoxycoformycin, cisplatin, cyclophosphamide, 5-fluorouracil, adriamycin, daunorubicin, tamoxifen aunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). See, generally, The Merck Manual of Diagnosis and Therapy, 15th Ed. 1987, pp. 1206-1228, Berkow et al., eds., Rahway, N.J. When used with the dsRNAs featured in the invention, such chemotherapeutic agents may be used individually (e.g., deoxycoformycin and dsRNA), sequentially (e.g., antiviral and dsRNA for a period of time, followed by deoxycoformycin and dsRNA), or in combination with one or more other such agents (e.g., deoxycoformycin, antiviral and dsRNA, or deoxycoformycin, radiotherapy and dsRNA). Two or more combined compounds may be used together or sequentially.

Patients can be administered a therapeutic amount of dsRNA, such as 0.02, 0.1, 0.5 mg/kg, 1.0 mg/kg, 1.5 mg/kg, 2.0 mg/kg, or 2.5 mg/kg dsRNA. The dsRNA can be administered by intravenous infusion over a period of time, such as over a 5 minute, 10 minute, 15 minute, 20 minute, or 25 minute period. In some embodiments, the administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the dsRNA can reduce LDL levels in the blood of the patient by at least 20%, 25%, 30%, 40%, 50%, 60%, 70%, 80% or 90% or more.

Before administration of a full dose of a dsRNA targeting XBP-1, a patient can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Many XBP-1-associated diseases and disorders are hereditary. Therefore, a patient in need of a dsRNA targeting XBP-1 can be identified by taking a family history. A healthcare provider, such as a doctor, nurse, or family member, can take a family history before prescribing or administering a dsRNA. A DNA test may also be performed on the patient to identify a mutation in the target gene, before a dsRNA is administered to the patient.

Methods for Inhibiting Expression of the XBP-1 Gene

In yet another aspect, the invention provides a method for inhibiting the expression of an XBP-1 gene in a mammal. The method includes administering a composition featured in the invention to the mammal such that expression of the target XBP-1 gene is silenced.

When the organism to be treated is a mammal such as a human, the composition may be administered by any means known in the art including, but not limited to oral or parenteral routes, including intravenous, intramuscular, subcutaneous, transdermal, airway (aerosol), nasal, rectal, and topical (including buccal and sublingual) administration. In certain embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the dsRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 dsRNA Synthesis

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 µmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

For the synthesis of 3'-cholesterol-conjugated siRNAs (herein referred to as -Chol-3'), an appropriately modified solid support is used for RNA synthesis. The modified solid support is prepared as follows:

Diethyl-2-azabutane-1,4-dicarboxylate AA

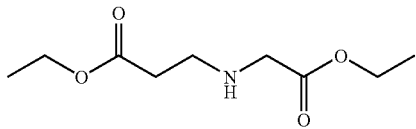

A 4.7 M aqueous solution of sodium hydroxide (50 mL) is added into a stirred, ice-cooled solution of ethyl glycinate hydrochloride (32.19 g, 0.23 mole) in water (50 mL). Then, ethyl acrylate (23.1 g, 0.23 mole) is added and the mixture stirred at room temperature until completion of the reaction is ascertained by TLC. After 19 h the solution is partitioned with dichloromethane (3×100 mL). The organic layer is dried with anhydrous sodium sulfate, filtered and evaporated. The residue is distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

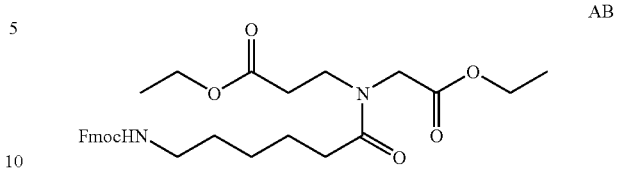

Fmoc-6-amino-hexanoic acid (9.12 g, 25.83 mmol) is dissolved in dichloromethane (50 mL) and cooled with ice. Diisopropylcarbodiimde (3.25 g, 3.99 mL, 25.83 mmol) is added to the solution at 0° C. This is followed by the addition of Diethyl-azabutane-1,4-dicarboxylate (5 g, 24.6 mmol) and dimethylamino pyridine (0.305 g, 2.5 mmol). The solution is brought to room temperature and stirred further for 6 h. Completion of the reaction is ascertained by TLC. The reaction mixture is concentrated under vacuum and ethyl acetate is added to precipitate diisopropyl urea. The suspension is filtered. The filtrate is washed with 5% aqueous hydrochloric acid, 5% sodium bicarbonate and water. The combined organic layer is dried over sodium sulfate and concentrated to give the crude product which is purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

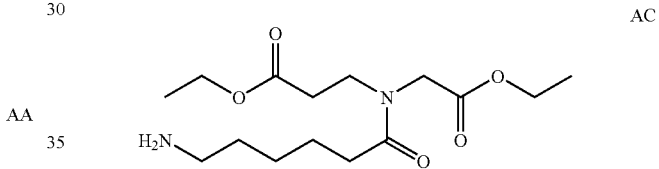

3-{Ethoxycarbonylmethyl-[6-(9H-fluoren-9-ylmethoxycarbonylamino)-hexanoyl]-amino}-propionic acid ethyl ester AB (11.5 g, 21.3 mmol) is dissolved in 20% piperidine in dimethylformamide at 0° C. The solution is continued stirring for 1 h. The reaction mixture is concentrated under vacuum, water is added to the residue, and the product is extracted with ethyl acetate. The crude product is purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD

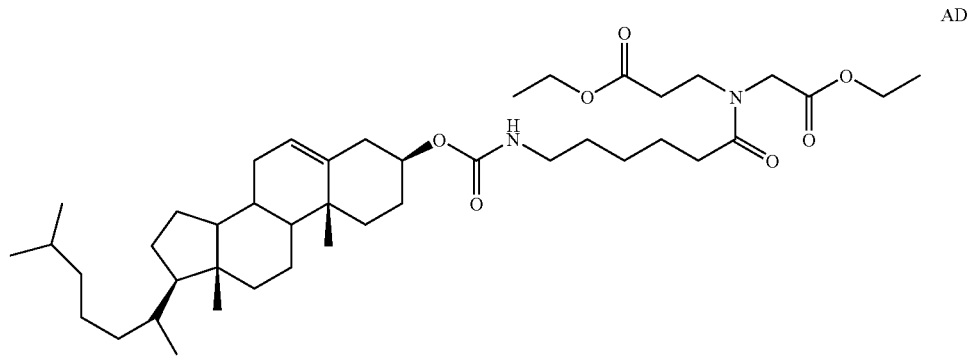

The hydrochloride salt of 3-[(6-Amino-hexanoyl)-ethoxy-carbonylmethyl-amino]-propionic acid ethyl ester AC (4.7 g, 14.8 mmol) is taken up in dichloromethane. The suspension is cooled to 0° C. on ice. Diisopropylethylamine (3.87 g, 5.2 mL, 30 mmol) is added to the suspension. To the resulting solution, cholesteryl chloroformate (6.675 g, 14.8 mmol) is added. The reaction mixture is stirred overnight. The reaction mixture is diluted with dichloromethane and washed with 10% hydrochloric acid. The product is purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a] phenanthren-3-yloxycarbonylamino]-hexanoyl}-4-oxo-pyrrolidine-3-carboxylic acid ethyl ester AE

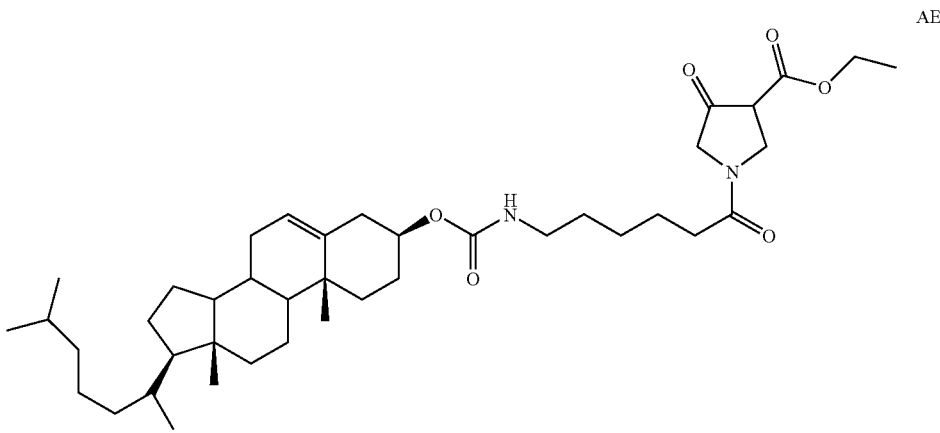

Potassium t-butoxide (1.1 g, 9.8 mmol) is slurried in 30 mL of dry toluene. The mixture is cooled to 0° C. on ice, and 5 g (6.6 mmol) of diester AD is added slowly with stirring within 20 mins. The temperature is kept below 5° C. during the addition. The stirring is continued for 30 mins at 0° C., and 1 mL of glacial acetic acid is added, immediately followed by 4 g of NaH$_2$PO$_4$.H$_2$O in 40 mL of water. The resultant mixture is extracted twice with 100 mL of dichloromethane each, and the combined organic extracts are washed twice with 10 mL of phosphate buffer each, dried, and evaporated to dryness. The residue is dissolved in 60 mL of toluene, cooled to 0° C. and extracted with three 50 mL portions of cold pH 9.5 carbonate buffer. The aqueous extracts are adjusted to pH 3 with phosphoric acid, and extracted with five 40 mL portions of chloroform which are combined, dried and evaporated to dryness. The residue is purified by column chromatography using 25% ethylacetate/hexane to afford 1.9 g of b-ketoester (39%).

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AF

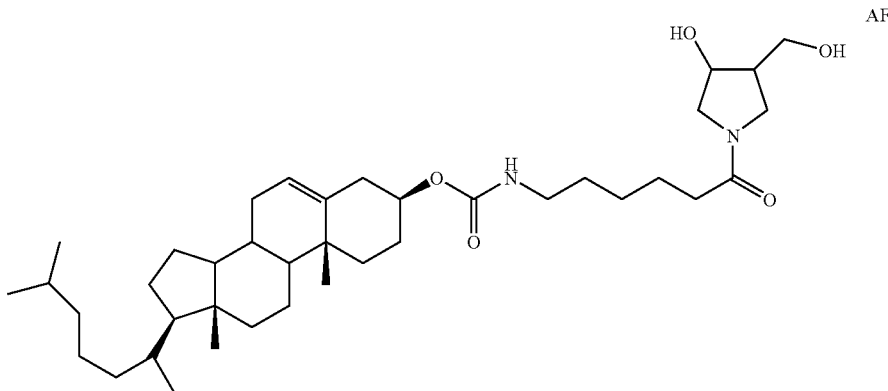

Methanol (2 mL) is added dropwise over a period of 1 h to a refluxing mixture of b-ketoester AE (1.5 g, 2.2 mmol) and sodium borohydride (0.226 g, 6 mmol) in tetrahydrofuran (10 mL). Stirring is continued at reflux temperature for 1 h. After cooling to room temperature, 1 N HCl (12.5 mL) is added, the mixture is extracted with ethylacetate (3×40 mL). The combined ethylacetate layer is dried over anhydrous sodium sulfate and concentrated under vacuum to yield the product which is purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG

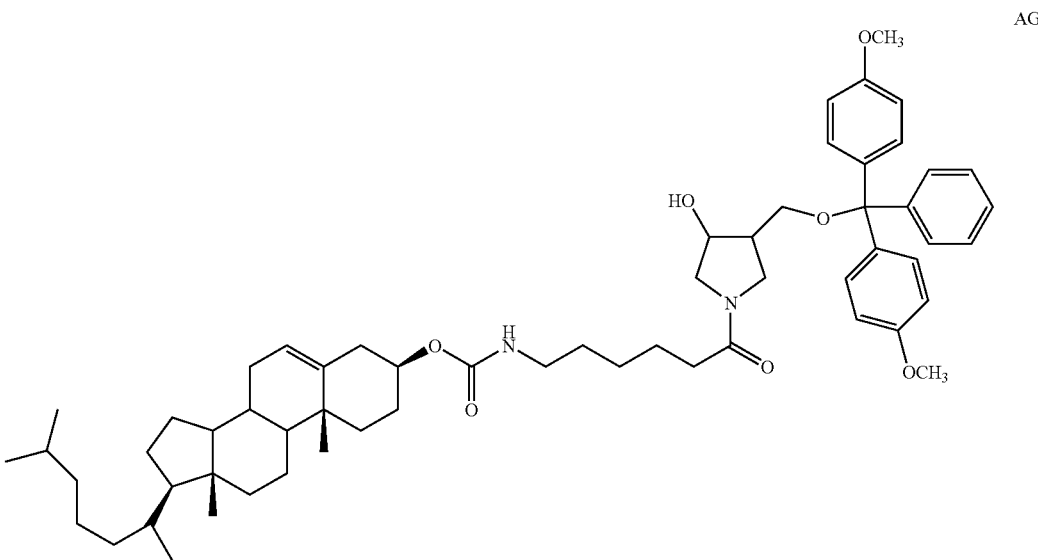

Diol AF (1.25 gm 1.994 mmol) is dried by evaporating with pyridine (2×5 mL) in vacuo. Anhydrous pyridine (10 mL) and 4,4'-dimethoxytritylchloride (0.724 g, 2.13 mmol) are added with stirring. The reaction is carried out at room temperature overnight. The reaction is quenched by the addition of methanol. The reaction mixture is concentrated under vacuum and dichloromethane (50 mL) is added to the residue. The organic layer is washed with 1M aqueous sodium bicarbonate. The organic layer is dried over anhydrous sodium sulfate, filtered and concentrated. The residual pyridine is removed by evaporating with toluene. The crude product is purified by column chromatography (2% MeOH/Chloroform, Rf=0.5 in 5% MeOH/CHCl$_3$) (1.75 g, 95%).

Succinic acid mono-(4-[bis-(4-methoxy-phenyl)-phenyl-methoxymethyl]-1-{6-[17-(1,5-dimethyl-hexyl)-10,13-dimethyl 2,3,4,7,8,9,10,11,12,13,14,15, 16,17-tetradecahydro-1H cyclopenta[a]phenanthren-3-yloxycarbonylamino]-hexanoyl}-pyrrolidin-3-yl) ester AH

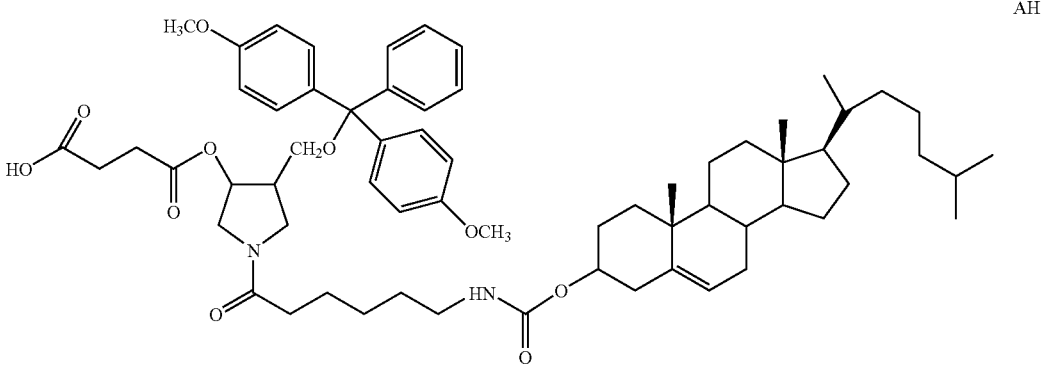

Compound AG (1.0 g, 1.05 mmol) is mixed with succinic anhydride (0.150 g, 1.5 mmol) and DMAP (0.073 g, 0.6 mmol) and dried in a vacuum at 40° C. overnight. The mixture is dissolved in anhydrous dichloroethane (3 mL), triethylamine (0.318 g, 0.440 mL, 3.15 mmol) is added and the solution is stirred at room temperature under argon atmosphere for 16 h. It is then diluted with dichloromethane (40 mL) and washed with ice cold aqueous citric acid (5 wt %, 30 mL) and water (2×20 mL). The organic phase is dried over anhydrous sodium sulfate and concentrated to dryness. The residue is used as such for the next step.

Cholesterol derivatised CPG AI

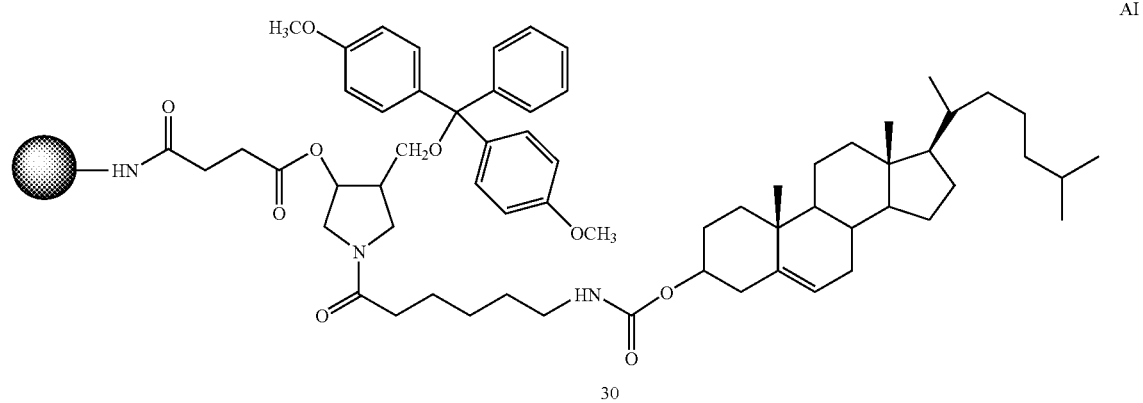

Succinate AH (0.254 g, 0.242 mmol) is dissolved in a mixture of dichloromethane/acetonitrile (3:2, 3 mL). To that solution, DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) are added successively. To the resulting solution triphenylphosphine (0.064 g, 0.242 mmol) in acetonitrile (0.6 ml) is added. The reaction mixture turns bright orange in color. The solution is agitated briefly using a wrist-action shaker (5 mins). Long chain alkyl amine-CPG (LCAA-CPG) (1.5 g, 61 mM) is added. The suspension is agitated for 2 h. The CPG is filtered through a sintered funnel and washed with acetonitrile, dichloromethane and ether successively. Unreacted amino groups are masked using acetic anhydride/pyridine. The achieved loading of the CPG was measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-Chol-") is performed as described in WO 2004/065601, except that, for the cholesteryl derivative, the oxidation step is performed using the Beaucage reagent in order to introduce a phosphorothioate linkage at the 5'-end of the nucleic acid oligomer.

Nucleic acid sequences are represented below using standard nomenclature, and specifically the abbreviations of Table 1.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
|---|---|
| A | Adenosine |
| C | Cytidine |
| G | Guanosine |
| T | thymidine |
| U | uridine |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
|---|---|
| N | any nucleotide (G, A, C, U, or T) |
| a | 2'-O-methyladenosine |
| c | 2'-O-methylcytidine |
| g | 2'-O-methylguanosine |
| u | 2'-O-methyluridine |
| sT | phosphorothioate linkage |

Example 2

Synthesis of XBP-1 dsRNAs

XBP-1 sequences were synthesized on MerMade 192 synthesizer at 1 µmol scale.

For all the sequences in Table 2, 'endolight' chemistry was applied as shown below and in Table 4.

All pyrimidines (cytosine and uridine) in the sense strand were replaced with corresponding 2'-O-Methyl bases (2' O-Methyl C and 2'-O-Methyl U)

In the antisense strand, pyrimidines adjacent to (towards 5' position) ribo A nucleoside were replaced with their corresponding 2-O-Methyl nucleosides A two base dTsdT extension at 3' end of both sense and anti sense sequences was introduced The sequence file was converted to a text file to make it compatible for loading in the MerMade 192 synthesis software Solid supported oligonucleotide synthesis using phosphoramidite chemistry was performed to synthesize the XBP-1 sequences.

TABLE 2

Exemplary XBP-1 dsRNAs

| Oligo Name | SEQ ID NO: | sense (5'-3') | SEQ ID NO: | antisense (5'-3') |
|---|---|---|---|---|
| NM_001004210_1128-1146 | 2127 | CCCAGCUGAUUAGUGUCUA | 2128 | UAGACACUAAUCAGCUGGG |
| NM_001004210_1129-1147 | 2129 | CCAGCUGAUUAGUGUCUAA | 2130 | UUAGACACUAAUCAGCUGG |
| NM_001004210_677-695 | 2131 | CUCCCAGAGGUCUACCCAG | 2132 | CUGGGUAGACCUCUGGGAG |
| NM_001004210_893-911 | 2133 | GAUCACCCUGAAUUCAUUG | 2134 | CAAUGAAUUCAGGGUGAUC |
| NM_001004210_895-913 | 2135 | UCACCCUGAAUUCAUUGUC | 2136 | GACAAUGAAUUCAGGGUGA |
| NM_001004210_1127-1145 | 2137 | CCCCAGCUGAUUAGUGUCU | 2138 | AGACACUAAUCAGCUGGGG |
| NM_001004210_894-912 | 2139 | AUCACCCUGAAUUCAUUGU | 2140 | ACAAUGAAUUCAGGGUGAU |
| NM_001004210_1760-1778 | 2141 | CAUUUAUUUAAAACUACCC | 2142 | GGGUAGUUUUAAAUAAAUG |
| NM_001004210_215-233 | 2143 | ACUGAAAAACAGAGUAGCA | 2144 | UGCUACUCUGUUUUUCAGU |
| NM_001004210_1759-1777 | 2145 | CCAUUUAUUUAAAACUACC | 2146 | GGUAGUUUUAAAUAAAUGG |
| NM_001004210_367-385 | 2147 | UUGAGAACCAGGAGUUAAG | 2148 | CUUAACUCCUGGUUCUCAA |
| NM_001004210_896-914 | 2149 | CACCCUGAAUUCAUUGUCU | 2150 | AGACAAUGAAUUCAGGGUG |
| NM_001004210_214-232 | 2151 | AACUGAAAAACAGAGUAGC | 2152 | GCUACUCUGUUUUUCAGUU |
| NM_001004210_216-234 | 2153 | CUGAAAAACAGAGUAGCAG | 2154 | CUGCUACUCUGUUUUUCAG |
| XM_001103095_387-405 | 1 | AGAAAAUCAGCUUUUACGA | 2 | UCGUAAAAGCUGAUUUUCU |
| XM_001103095_1151-1169 | 3 | UCCCCAGCUGAUUAGUGUC | 4 | GACACUAAUCAGCUGGGGA |
| XM_001103095_1466-1484 | 5 | UACUUAUUAUGUAAGGGUC | 6 | GACCCUUACAUAAUAAGUA |
| XM_001103095_1435-1453 | 7 | UAUCUUAAAAGGGUGGUAG | 8 | CUACCACCCUUUUAAGAUA |
| XM_001103095_577-595 | 9 | CCAUGGAUUCUGGCGGUAU | 10 | AUACCGCCAGAAUCCAUGG |
| XM_001103095_790-808 | 11 | UUAAUGAACUAAUUCGUUU | 12 | AAACGAAUUAGUUCAUUAA |
| XM_001103095_1479-1497 | 13 | AGGGUCAUUAGACAAAUGU | 14 | ACAUUUGUCUAAUGACCCU |
| XM_001103095_794-812 | 15 | UGAACUAAUUCGUUUUGAC | 16 | GUCAAAACGAAUUAGUUCA |
| XM_001103095_1150-1168 | 23 | UUCCCCAGCUGAUUAGUGU | 24 | ACACUAAUCAGCUGGGGAA |
| XM_001103095_1473-1491 | 25 | UAUGUAAGGGUCAUUAGAC | 26 | GUCUAAUGACCCUUACAUA |

The synthesis of the sequences in Tables 2 and 4 was performed at 1 μm scale in 96-well plates. The amidite solutions were prepared at 0.1M concentration and ethyl thio tetrazole (0.6M in acetonitrile) was used as an activator.

The synthesized sequences were cleaved and deprotected in 96-well plates, using methylamine in the first step and pyradine.3HF in the second step. The crude sequences thus obtained were precipitated using an acetone:ethanol mix, and the pellets were resuspended in 0.5M sodium acetate buffer. Samples from each sequence were analyzed by LC-MS and the resulting mass data confirmed the identity of the sequences. A selected set of samples was also analyzed by IEX chromatography.

The sequences were purified on an AKTA explorer purification system using a Source Q column. A single peak corresponding to the full length sequence was collected in the eluent and was subsequently analyzed for purity by ion exchange chromatography.

The purified sequences were desalted on a Sephadex G25 column using an AKTA purifier. The desalted XBP-1 sequences were analyzed for concentration and purity. The single strands were then submitted for annealing.

TABLE 3

XBP-1 oligos with Endolight Chemistry Modifications

| Duplex Name | Species specificity and target sequence from 5' to 3' on mRNA transcript | Oligo name Sense | Oligo name Antisense |
|---|---|---|---|
| AD18027 | NM_001004210_1128-1146 | A-31668 | A-31669 |
| AD18028 | NM_001004210_1129-1147 | A-31670 | A-31671 |
| AD18029 | NM_001004210_677-695 | A-31672 | A-31673 |
| AD18030 | NM_001004210_893-911 | A-31674 | A-31675 |
| AD18031 | NM_001004210_895-913 | A-31676 | A-31677 |
| AD18032 | NM_001004210_1127-1145 | A-31678 | A-31679 |
| AD18033 | NM_001004210_894-912 | A-31680 | A-31681 |

TABLE 3-continued

XBP-1 oligos with Endolight Chemistry Modifications

| Duplex Name | Species specificity and target sequence from 5' to 3' on mRNA transcript | Oligo name Sense | Oligo name Antisense |
|---|---|---|---|
| AD18034 | NM_001004210_1760-1778 | A-31682 | A-31683 |
| AD18035 | NM_001004210_215-233 | A-31684 | A-31685 |
| AD18036 | NM_001004210_1759-1777 | A-31686 | A-31687 |
| AD18037 | NM_001004210_367-385 | A-31688 | A-31689 |
| AD18038 | NM_001004210_896-914 | A-31690 | A-31691 |
| AD18039 | NM_001004210_214-232 | A-31692 | A-31693 |
| AD18040 | NM_001004210_216-234 | A-31694 | A-31695 |
| AD18041 | XM_001103095_387-405 | A-31696 | A-31697 |
| AD18042 | XM_001103095_1151-1169 | A-31698 | A-31699 |
| AD18043 | XM_001103095_1466-1484 | A-31700 | A-31701 |
| AD18044 | XM_001103095_1435-1453 | A-31702 | A-31703 |
| AD18045 | XM_001103095_577-595 | A-31704 | A-31705 |
| AD18046 | XM_001103095_790-808 | A-31706 | A-31707 |
| AD18047 | XM_001103095_1479-1497 | A-31708 | A-31709 |
| AD18048 | XM_001103095_794-812 | A-31710 | A-31711 |
| AD18049 | XM_001103095_1150-1168 | A-31712 | A-31713 |
| AD18050 | XM_001103095_1473-1491 | A-31714 | A-31715 |

TABLE 4

XBP-1 sequences with Endolight chemistry modifications

| Oligo name Sense | SEQ ID NO: | Sense (5'-3') | Oligo name Antisense | SEQ ID NO: | Antisense (5'-3') |
|---|---|---|---|---|---|
| A-31668 | 2155 | cccAGcuGAuuAGuGucuAdTsdT | A-31669 | 2156 | uAGAcACuAAUcAGCUGGGdTsdT |
| A-31670 | 2157 | ccAGcuGAuuAGuGucuAAdTsdT | A-31671 | 2158 | UuAGAcACuAAUcAGCUGGGdTsdT |
| A-31672 | 2159 | cucccAGAGGucuAcccAGdTsdT | A-31673 | 2160 | CUGGGuAGACCUCUGGGAGdTsdT |
| A-31674 | 2161 | GAucAcccuGAAuucAuuGdTsdT | A-31675 | 2162 | cAAUGAAUUcAGGGUGAUCdTsdT |
| A-31676 | 2163 | ucAcccuGAAuucAuuGucdTsdT | A-31677 | 2164 | GAcAAUGAAUUcAGGGUGAdTsdT |
| A-31678 | 2165 | ccccAGcuGAuuAGuGucudTsdT | A-31679 | 2166 | AGAcAcuAAUcAGCUGGGGdTsdT |
| A-31680 | 2167 | AucAcccuGAAuucAuuGudTsdT | A-31681 | 2168 | ACAAUGAAUUcAGGGUGAUdTsdT |
| A-31682 | 2169 | cAuuuAuuuAAAAcuAcccdTsdT | A-31683 | 2170 | GGGuAGUUUuAAAuAAAUGdTsdT |
| A-31684 | 2171 | AcuGAAAAAcAGAGuAGcAdTsdT | A-31685 | 2172 | UGCuACUCUGUUUUUcAGUdTsdT |
| A-31686 | 2173 | ccAuuuAuuuAAAAcuAccdTsdT | A-31687 | 2174 | GGuAGUUUuAAAuAAAUGGdTsdT |
| A-31688 | 2175 | uuGAGAAccAGGAGuuAAGdTsdT | A-31689 | 2176 | CUuAACUCCUGGUUCUcAAdTsdT |
| A-31690 | 2177 | cAcccuGAAuucAuuGucudTsdT | A-31691 | 2178 | AGAcAAUGAAUUcAGGGUGAdTsdT |
| A-31692 | 2179 | AAcuGAAAAAcAGAGuAGcAdTsdT | A-31693 | 2180 | GCuACUCUGUUUUUcAGUUdTsdT |
| A-31694 | 2181 | cuGAAAAAcAGAGuAGcAGdTsdT | A-31695 | 2182 | CUGCuACUCUGUUUUUcAGUdTsdT |
| A-31696 | 2183 | AGAAAAucAGcuuuuAcGAdTsdT | A-31697 | 2184 | UCGuAAAAGCUGAUUUUCUdTsdT |
| A-31698 | 2185 | uccccAGcuGAuuAGuGucdTsdT | A-31699 | 2186 | GACACuAAUcAGCUGGGGAdTsdT |
| A-31700 | 2187 | uAcuuAuuAuGuAAGGGucdTsdT | A-31701 | 2188 | GACCCUuAcAuAAuAAGuAdTsdT |
| A-31702 | 2189 | uAucuuAAAAGGGuGGuAGdTsdT | A-31703 | 2190 | CuACcACCCUUUuAAGAuAdTsdT |
| A-31704 | 2191 | ccAuGGAuucuGGcGGuAudTsdT | A-31705 | 2192 | AuACCGCcAGAAUCcAUGGdTsdT |
| A-31706 | 2193 | uuAAuGAcuAAuucGuuudTsdT | A-31707 | 2194 | AAACGAAUuAGUUcAUuAAdTsdT |
| A-31708 | 2195 | AGGGucAuuAGAcAAAuGudTsdT | A-31709 | 2196 | AcAUUUGUCuAAUGACCCUdTsdT |
| A-31710 | 2197 | uGAAcuAAuucGuuuuGAcdTsdT | A-31711 | 2198 | GUcAAAACGAAUuAGUUcAdTsdT |
| A-31712 | 2199 | uuccccAGcuGAuuAGuGudTsdT | A-31713 | 2200 | AcACuAAUcAGCUGGGGAAdTsdT |
| A-31714 | 2201 | uAuGuAAGGGucAuuAGAcdTsdT | A-31715 | 2202 | GUCuAAUGACCCUuAcAuAdTsdT |

Example 3

Single Concentration Silencing Experiment (% Knockdown Relative to Control 12 nM)

Transfection of PC-3 cells was performed in 6-well plates: 31.25 μl (for 12.5 nM) of 200 nM duplex was added to 500 μl Opti-MEM (Invitrogen, Carlsbad, Calif.) in a well of a 6-well plate. 5 μl Lipofectamine™ RNAiMAX (Invitrogen, Carlsbad, Calif.) was added to the wells, mixed and incubated for 15 minutes. 2.0 ml complete growth media without Antibiotics containing $0.6\times10^5$ cells was added, and the mixture was mixed by rocking back and forth for 36 hours. Total RNA was isolated using Qiagen RNeasy kit (Qiagen, Valencia, Calif.) according to the manufacturer's instructions. RNA concentration was measured using a nanodrop and was diluted to 2 μg per 10 μl.

cDNA was synthesized using an ABI High-capacity cDNA reverse transcription kit (Applied Biosystems, Foster City, Calif.) and 2 μg total RNA. Quantitative PCR (qPCR) was performed using probes to amplify XBP-1 and 18S in the same reaction. All reactions were performed in triplicate.

qPCR data were analyzed using the ΔΔCt method using BlockiT™ fluorescent Oligo (Invitrogen, Carlsbad, Calif.), which does not target any human gene, as a negative control.

Generation of IC50s (for AD18028, AD18029, AD18037, AD18038, AD18040)

IC50s were generated for the 5 duplexes that showed the best silencing in the single concentration experiment.

Three sets of transfections were performed in two independent experiments using the dsRNAs shown in Table 4. In the first experiment, qPCR experiment 1 (qPCR1) and branched DNA (bDNA) results were obtained from different transfections that were done in parallel using the same cells and reagents. In the second experiment, qPCR2 results were generated from transfections that were done under the same conditions as the first experiment.

Transfection of PC-3 cells was performed in 96-well plates. The duplex concentrations tested were 50 nM, 10 nM, 5 nM, 1 nM, 0.5 nM, 0.1 nM, 0.05 nM, 0.01 nM, 0.005 nM, 0.001 nM, 0.0005 nM, and 0.0001 nM. Each dsRNA was diluted so that 5 μl would be added to 100 μl for each transfection to give the desired concentration. Transfections were performed using Opti-MEM and lipofectamine, and then cultured in EMEM.

RNA was extracted using an RNAqueous 96 kit (Applied Biosystems/Ambion, Austin, Tex.) according to manufactures instructions.

cDNA synthesis and qPCR were done as described above, and qPCR data were analyzed using the ΔΔCt method using AD-3966 as a control, which targets the Sid1 gene but has been shown to have no activity in cell based assays.

Branched DNA assays were performed using QuantiGene® 2.0 (Panomics, Fremont, Calif.). The bDNA data were analyzed by subtracting the average background from each triplicate sample, averaging the triplicate GAPDH (control probe) and TTR (experimental probe) then taking the ratio:

(experimental probe-background)/(control probe-background).

The results are shown in Tables 5 and 6.

TABLE 5

IC50 results for XBP-1 dsRNA

| oligoName | Human antisScore | Mouse antisScore | Rat antisScore | Rhesus antisScore | IC50 (nM) qPCR 1 | IC50 (nM) qPCR 2 | IC50 (nM) bDNA |
|---|---|---|---|---|---|---|---|
| AD18027 | 3 | 2 | 3 | 3 | | | |
| AD18028 | 3 | 2 | 3.2 | 3 | 0.019 | 0.011 | 0.034 |
| AD18029 | 3 | 1.2 | 2.8 | 3 | 0.03 | 0.020 | 0.026 |
| AD18030 | 3 | 2 | 1 | 2 | | | |
| AD18031 | 3 | 2 | 3 | 2.2 | | | |
| AD18032 | 3 | 2.2 | 3 | 2.8 | | | |
| AD18033 | 3 | 3 | 2.8 | 2 | | | |
| AD18034 | 2.2 | 2 | 2.8 | 2 | | | |
| AD18035 | 2.2 | 2 | 2 | 2.4 | | | |
| AD18036 | 2.2 | 2 | 2 | 2 | | | |
| AD18037 | 2.2 | 2 | 2 | 2.2 | 0.016 | 0.019 | 0.016 |
| AD18038 | 2.2 | 2 | 3 | 2.2 | 0.004 | 0.003 | 0.006 |
| AD18039 | 2.2 | 3 | 2 | 2.2 | | | |
| AD18040 | 2.2 | 2 | 2 | 2 | 0.057 | 0.052 | 0.065 |
| AD18041 | 4 | NH | NH | 3.4 | | | |
| AD18042 | 4 | NH | NH | 3.2 | | | |
| AD18043 | 4 | NH | NH | 3 | | | |
| AD18044 | 3.2 | NH | NH | 3.2 | | | |
| AD18045 | 3.2 | NH | NH | 3.2 | | | |
| AD18046 | 3.2 | NH | NH | 3.2 | | | |
| AD18047 | 3.2 | NH | NH | 3 | | | |
| AD18048 | 3.2 | NH | NH | 3 | | | |
| AD18049 | 3 | NH | NH | 3.2 | | | |
| AD18050 | 3 | NH | NH | 3.2 | | | |

NH = No homology;
bold = perfect match with hamster

TABLE 6

XBP-1 Silencing Data

| oligo Name | % knockdown relative to control (12 nM) (36 hours) | IC50 (nM) qPCR 1 | IC50 (nM) qPCR 2 | IC50 (nM) bDNA |
|---|---|---|---|---|
| AD18027 | 81.993 | | | |
| AD18028 | 90.581 | 0.019 | 0.011 | 0.034 |
| AD18029 | 97.749 | 0.03 | 0.02 | 0.026 |
| AD18030 | 82.845 | | | |
| AD18031 | 34.782 | | | |
| AD18032 | 84.893 | | | |
| AD18033 | 68.971 | | | |
| AD18034 | 42.962 | | | |
| AD18035 | 82.076 | | | |
| AD18036 | 77.26 | | | |
| AD18037 | 94.209 | 0.016 | 0.019 | 0.016 |
| AD18038 | 93.239 | 0.004 | 0.003 | 0.006 |
| AD18039 | 56.873 | | | |
| AD18040 | 93.75 | 0.057 | 0.052 | 0.065 |
| AD18041 | 84.396 | | | |
| AD18042 | ND | | | |
| AD18043 | 27.804 | | | |
| AD18044 | 64.316 | | | |
| AD18045 | 14.933 | | | |
| AD18046 | −2.101 | | | |
| AD18047 | 62.456 | | | |
| AD18048 | 74.534 | | | |
| AD18049 | 2.284 | | | |
| AD18050 | 59.621 | | | |

Example 4

Screening siRNA Sequences for Immunostimulatory Ability

Human PBMC were isolated from freshly collected buffy coats obtained from healthy donors (Research Blood Components, Inc., Boston, Mass.) by a standard Ficoll-Hypaque density centrifugation. Freshly isolated cells ($1 \times 10^5$/well) were seeded in 96-well plates and cultured in RPMI 1640 GlutaMax medium (Invitrogen) supplemented with 10% heat-inactivated fetal bovine serum and 1% antibiotic/antimycotic (Invitrogen).

siRNAs were transfected into PBMC using two separate transfection reagents: GenePorter 2 (GP2; Genlantis) and DOTAP (Roche Applied Science). The transfection reagent was first diluted in Opti-MEM (Invitrogen) for 5 minutes before mixing with an equal volume of Opti-MEM containing the siRNA. siRNA/transfection reagent complexes were incubated as specified by the reagent manufacturers' instructions and subsequently added to PBMC. siRNAs were used at a final concentration of 133 nM. The ratio of RNA to transfection reagent was 33 pmoles and 16.5 pmoles, respectively, per ul of GP2 and DOTAP.

Cytokines were detected and quantified in culture supernatants with a commercially available ELISA kit for IFN-α (BMS216INST) and TNF-α (BMS223INST); both from Bender MedSystems (Vienna, Austria).

The results are shown in Table 7.

TABLE 7

XBP-1 targeted siRNAs are not immunostimulatory for human PBMC

| | Donor A | | Donor B | |
|---|---|---|---|---|
| | pg/ml | | | |
| Transfection | IFN-α | TNF-α | IFN-α | TNF-α |
| Medium only | −36 ± 5 | −20 ± 13 | −35 ± 7 | 125 ± 48 |
| DOTAP only | −49 ± 5 | −39 ± 4 | −36 ± 11 | 110 ± 81 |
| AD-1730 | −6 ± 11 | 1859 ± 276 | 141 ± 42 | 1082 ± 181 |
| AD-1955 | −35 ± 8 | 32 ± 7 | −40 ± 10 | 59 ± 27 |
| AD-2153 | 302 ± 32 | 62 ± 46 | 531 ± 44 | 158 ± 26 |
| AD-5048 | 473 ± 63 | 1244 ± 217 | 592 ± 41 | 785 ± 121 |
| AD-18028 | −39 ± 9 | −39 ± 7 | −23 ± 16 | 162 ± 49 |
| AD-18029 | −35 ± 11 | −31 ± 8 | −26 ± 16 | 24 ± 40 |
| AD-18037 | −28 ± 20 | −24 ± 14 | 30 ± 6 | −44 ± 27 |
| AD-18038 | −24 ± 18 | −5 ± 17 | −37 ± 11 | 32 ± 56 |
| AD-18040 | −31 ± 17 | −12 ± 17 | −37 ± 8 | −43 ± 14 |

Cytokine Responses of Whole PBMC to Duplex siRNAs Targeting XBP-1

Freshly isolated PBMC from two normal donors (A and B) were transfected with test siRNAs using DOTAP and cultured for 24 hours. Subsequently, culture supernatants were collected and IFN-α and TNF-α levels measured by ELISA. AD-1730, AD-1955, and AD-2153 are sequences that bear no known homology to any human genes. AD-1730 and AD-2153 preferentially stimulate TNF-α and IFN-α, respectively. AD-5048 corresponds to a sequence that targets human Apolipoprotein B (Soutschek et al., 2004) and elicits both and IFN-α and TNF-α AD-1995 is a non-stimulatory sequence used as a negative control. The data shown are derived from a single experiment in which four replicate wells were transfected with each siRNA or were treated with either DOTAP or medium alone. Values represent the mean±standard deviation for four biological replicates.

Example 5

The Effect of XBP-1 siRNA on Hepatic Lipogenesis in Mice

Dietary carbohydrates regulate hepatic lipogenesis by controlling the expression of critical enzymes in glycolysis and lipogenic pathways. XBP-1, a regulator of the Unfolded Protein Response (UPR), is important for de novo fatty acid synthesis in the liver, a function unrelated to its role in the UPR. (Lee et al., Science (2009) 320:1492-1496) XBP-1 protein expression is induced in the liver by a high carbohydrate diet and controls the induction of genes involved in fatty acid synthesis. Selective deletion of XBP-1 in liver resulted in marked hypocholesterolemia and hypotriglyceridemia secondary to a decreased production of lipids from the liver. (Lee et al. (2009)) Notably, this phenotype was not accompanied by hepatic steatosis or significantly compromised protein secretory function.

XBP-1 accelerates de novo fatty acid synthesis in the liver while preserving normal hepatic lipid composition, a profile that is highly relevant to the treatment of diseases, such as atherosclerosis, that are associated with dyspipidemia. Inhibition of XBP-1 may also be useful therapeutics for the treatment of Nonalcoholic Fatty Liver Disease (NAFLD) and steatohepatitis (NASH), which lead to accelerated morbidity and mortality.

In order to determine whether XBP-1 downregulation by siRNAs would be an effective strategy to reduce lipid levels and treat dyslipidemias and metabolic syndromes, siRNAs were designed to target XBP-1.

Knock-Down of XBP-1 mRNA in the Liver and Decrease of Plasma Cholesterol Levels by Lipidoid Formulated siRNA Animal dosing: Bolus dosing of LNP01 formulated siRNAs in C57/BL6 mice (5/group, 18-20 g body weight, Charles River Laboratories, MA) was performed by low volume tail vein injection using a 27 G needle. Mice were dosed with two siRNAs targeting XBP-1 (LNP01-18037 and LNP01-18038) and a control luciferase targeting siRNA (LNP01-1955) at 5 and 7.5 mg/kg. Animals were kept under an infrared lamp for approximately 3 min prior to dosing to ease injection. 48 hour post dose animals were sacrificed by $CO_2$-asphyxiation. 0.2 ml blood was collected by retro-orbital bleeding. Liver was harvested and frozen in liquid nitrogen. Serum and livers were stored at −80° C. Total serum cholesterol in mouse serum was measured using the Wako Cholesterol E enzymatic colorimetric method (Wako Chemicals USA, Inc., Richmond, Va., USA) according to manufacturer's instructions. Measurements were taken on a VersaMax™ Tunable microplate reader (Molecular Devices, Sunnyvale, Calif.) using SoftMax® Pro software. Message levels of the target gene XBP-1 were measured via bDNA analysis as below.

bDNA analysis: Frozen livers were grinded using 6850 Freezer/Mill Cryogenic Grinder (SPEX CentriPrep, Inc.) and powders stored at −80° C. until analysis.

Figure 6:
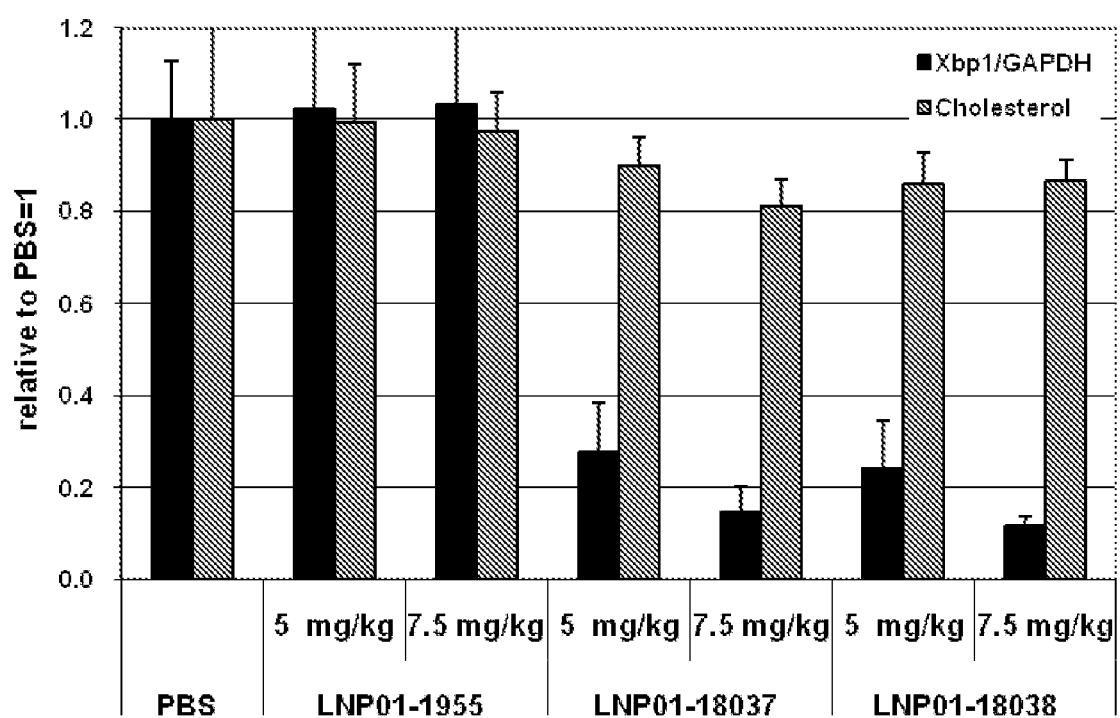
FIG. 6 illustrates mXBP-1 and cholesterol levels after XBP-1 siRNA injection in C57BL/6 mice.

XBP-1 mRNA levels were detected using the branched-DNA technology based QuantiGene® Reagent System (Panomics, Fremont, Calif., U.S.A.) according to the protocol. 10-20 mg of frozen liver powders was lysed in 600 ul of 0.3 ug/ml Proteinase K (Epicentre®, #MPRK092) in Tissue and Cell Lysis Solution (Epicentre®, #MTC096H) at 65° C. for 1 hour. Then 10 ul of the lysates were added to 90 μl of Lysis Working Reagent (1 volume of stock Lysis Mixture in two volumes of water) and incubated at 55° C. overnight on Panomics capture plates with probe sets specific to mouse XBP-1 and mouse GAPDH (Panomics, U.S.A.). Capture plates then were processed for signal amplification and detection according to the protocol and chemiluminescence was read as relative light units (RLUs) on a microplate luminometer Victor2-Light (Perkin Elmer). The ratio of XBP-1 mRNA to GAPDH mRNA in liver lysates was averaged over each treatment group and compared to a control group treated with PBS As shown in FIG. 6, as compared to the PBS control, treatment of mice with compounds LNP01-18037, and LNP01-18038, but not with unrelated siRNA control LNP01-1955 resulted in significant and dose dependent (72-88%) lowering of XBP-1 transcript levels in mouse liver (as indicated by a smaller XBP-1 to GAPDH transcript ratio when normalized to a PBS control group), indicating that siRNA molecules were active in vivo. As shown in FIG. 6, the silencing activity translated in lowering of total cholesterol in those animals.

Example 6

Cleavage of XBP-1 siRNAs

5'RACE was used to examine the cleavage products of XBP-1 siRNAs isolated from livers of mice injected with the oligonucleotides.

Mice were injected with 5 mg/kg or 7.5 mg/kg lipid-formulated XBP-1 siRNAs (LNP01-18038, negative control siRNAs targeting luciferase (LNP01-1955), or PBS. Total RNA was isolated from powdered liver samples using Trizol (Invitrogen) and RNAeasy mini columns (Qiagen). Two micrograms of RNA were used for 5'RACE similar to the Generacer kit (Invitrogen) protocol. The oligonucleotide adaptor was ligated directly to total RNA using T4 RNA ligase (2U) for 1 hour at 37° C. The ligation mixture was reverse transcribed using the XBP-1-specific oligo 5'-GGAAGCAGAGAGTGGAGAAAGAAATGCTAAGG-3' (SEQ ID NO:4335) using Superscript™ III (Invitrogen) for 1 hour at 50° C., then 15 min. at 70° C. cDNA was amplified using 3 ul of cDNA amplified with Platinum Taq (Invitrogen) for 35 cycles where Tm=62° C. with oligos 5'-CGACTGGAGCACGAGGACACTGACATGG-3' (SEQ ID NO:4336) and 5'-CCAGTGTTATGTGGCTCTTTAGACAC-TAATCAG-3' (SEQ ID NO:4337). PCR products were examined by gel electrophoresis, purified, and cloned into pCR4-TOPO vector for sequencing (Invitrogen).

PCR experiments on the 5' RACE product were performed in a blind fashion. One round of PCR was performed using Tm=62° C., for 35 cycles. The expected XBP-1 product size was 320 bp. The PCR products were roughly the correct size in all experimental samples, but products appeared to exhibit a high level of degradation the same location as the siRNA-intended cleavage site. Three bands from each of the experimental groups were cut from agarose gels for cloning and sequencing.

The control groups yielded clones with several degradation products resulting from cleavage around but not located at the expected cleavage site. The expected and observed cleavage products in the negative control samples are shown in FIG. 1A. The AD18038 siRNA was expected to cleave after nucleotide 925 in the XBP-1 transcript (see FIGS. 1A, 1B, and 3). Thus, no cleavage products at nucleotide position 925 were expected, and in fact, none were observed, in the negative control products (FIG. 1A). Degradation products in the negative control samples were found at positions −49, −35, −32(2), −31, −30(2), −28, −24, −22, −16(2), −17, −15, −14, −12, −11, −9, +8, +13, +65, and +68, relative to the intended cleavage site of the XBP-1 siRNA AD18038.

Figure 1B:

The expected siRNA-mediated cleavage product was found in 76.5% of the clones derived from the AD18038-treated groups (FIG. 1B). Degradation products were found from cleavage at positions −30, −10, −8, −5, −3, +1, +3, and +14, relative to the intended cleavage site of the XBP-1 siRNA AD18038.

TABLE 8

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_390-408 | AGAAAAUCAGCUUUUACGA | 1 | UCGUAAAAGCUGAUUUUCU | 2 |
| NM_005080_1184-1202 | UCCCCAGCUGAUUAGUGUC | 3 | GACACUAAUCAGCUGGGGA | 4 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1494-1512 | UACUUAUUAUGUAAGGGUC | 5 | GACCCUUACAUAAUAAGUA | 6 |
| NM_005080_1463-1481 | UAUCUUAAAAGGGUGGUAG | 7 | CUACCACCCUUUUAAGAUA | 8 |
| NM_005080_610-628 | CCAUGGAUUCUGGCGGUAU | 9 | AUACCGCCAGAAUCCAUGG | 10 |
| NM_005080_823-841 | UUAAUGAACUAAUUCGUUU | 11 | AAACGAAUUAGUUCAUUAA | 12 |
| NM_005080_1507-1525 | AGGGUCAUUAGACAAAUGU | 13 | ACAUUUGUCUAAUGACCCU | 14 |
| NM_005080_827-845 | UGAACUAAUUCGUUUUGAC | 15 | GUCAAAACGAAUUAGUUCA | 16 |
| NM_005080_1503-1521 | UGUAAGGGUCAUUAGACAA | 17 | UUGUCUAAUGACCCUUACA | 18 |
| NM_005080_829-847 | AACUAAUUCGUUUUGACCA | 19 | UGGUCAAAACGAAUUAGUU | 20 |
| NM_005080_1783-1801 | UAUUUAAAACUACCCAUGC | 21 | GCAUGGGUAGUUUUAAAUA | 22 |
| NM_005080_1183-1201 | UUCCCCAGCUGAUUAGUGU | 23 | ACACUAAUCAGCUGGGGAA | 24 |
| NM_005080_1501-1519 | UAUGUAAGGGUCAUUAGAC | 25 | GUCUAAUGACCCUUACAUA | 26 |
| NM_005080_1504-1522 | GUAAGGGUCAUUAGACAAA | 27 | UUUGUCUAAUGACCCUUAC | 28 |
| NM_005080_734-752 | GCUCCCAGAGGUCUACCCA | 29 | UGGGUAGACCUCUGGGAGC | 30 |
| NM_005080_893-911 | GAGCCAAGCUAAUGUGGUA | 31 | UACCACAUUAGCUUGGCUC | 32 |
| NM_005080_1064-1082 | CUGCCUACUGGAUGCUUAC | 33 | GUAAGCAUCCAGUAGGCAG | 34 |
| NM_005080_1066-1084 | GCCUACUGGAUGCUUACAG | 35 | CUGUAAGCAUCCAGUAGGC | 36 |
| NM_005080_1136-1154 | GCUUGGUGUAAACCAUUCU | 37 | AGAAUGGUUUACACCAAGC | 38 |
| NM_005080_1137-1155 | CUUGGUGUAAACCAUUCUU | 39 | AAGAAUGGUUUACACCAAG | 40 |
| NM_005080_1182-1200 | UUUCCCCAGCUGAUUAGUG | 41 | CACUAAUCAGCUGGGGAAA | 42 |
| NM_005080_1186-1204 | CCCAGCUGAUUAGUGUCUA | 43 | UAGACACUAAUCAGCUGGG | 44 |
| NM_005080_1189-1207 | AGCUGAUUAGUGUCUAAGG | 45 | CCUUAGACACUAAUCAGCU | 46 |
| NM_005080_1224-1242 | UGCCCUUUUCCUUGACUAU | 47 | AUAGUCAAGGAAAAGGGCA | 48 |
| NM_005080_1229-1247 | UUUUCCUUGACUAUUACAC | 49 | GUGUAAUAGUCAAGGAAAA | 50 |
| NM_005080_1235-1253 | UUGACUAUUACACUGCCUG | 51 | CAGGCAGUGUAAUAGUCAA | 52 |
| NM_005080_1236-1254 | UGACUAUUACACUGCCUGG | 53 | CCAGGCAGUGUAAUAGUCA | 54 |
| NM_005080_1438-1456 | ACUACAGCUUUUAAGAUUG | 55 | CAAUCUUAAAAGCUGUAGU | 56 |
| NM_005080_1441-1459 | ACAGCUUUUAAGAUUGUAC | 57 | GUACAAUCUUAAAAGCUGU | 58 |
| NM_005080_1442-1460 | CAGCUUUUAAGAUUGUACU | 59 | AGUACAAUCUUAAAAGCUG | 60 |
| NM_005080_1493-1511 | AUACUUAUUAUGUAAGGGU | 61 | ACCCUUACAUAAUAAGUAU | 62 |
| NM_005080_1502-1520 | AUGUAAGGGUCAUUAGACA | 63 | UGUCUAAUGACCCUUACAU | 64 |
| NM_005080_1506-1524 | AAGGGUCAUUAGACAAAUG | 65 | CAUUUGUCUAAUGACCCUU | 66 |
| NM_005080_1594-1612 | UUGCCUCCAGUUUUAGGUC | 67 | GACCUAAAACUGGAGGCAA | 68 |
| NM_005080_1790-1808 | AACUACCCAUGCAAUUAAA | 69 | UUUAAUUGCAUGGGUAGUU | 70 |
| NM_005080_304-322 | ACUGCCAGAGAUCGAAAGA | 71 | UCUUUCGAUCUCUGGCAGU | 72 |
| NM_005080_305-323 | CUGCCAGAGAUCGAAAGAA | 73 | UUCUUUCGAUCUCUGGCAG | 74 |
| NM_005080_395-413 | AUCAGCUUUUACGAGAGAA | 75 | UUCUCUCGUAAAAGCUGAU | 76 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_609-627 | CCCAUGGAUUCUGGCGGUA | 77 | UACCGCCAGAAUCCAUGGG | 78 |
| NM_005080_611-629 | CAUGGAUUCUGGCGGUAUU | 79 | AAUACCGCCAGAAUCCAUG | 80 |
| NM_005080_617-635 | UUCUGGCGGUAUUGACUCU | 81 | AGAGUCAAUACCGCCAGAA | 82 |
| NM_005080_621-639 | GGCGGUAUUGACUCUUCAG | 83 | CUGAAGAGUCAAUACCGCC | 84 |
| NM_005080_641-659 | UUCAGAGUCUGAUAUCCUG | 85 | CAGGAUAUCAGACUCUGAA | 86 |
| NM_005080_648-666 | UCUGAUAUCCUGUUGGGCA | 87 | UGCCCAACAGGAUAUCAGA | 88 |
| NM_005080_651-669 | GAUAUCCUGUUGGGCAUUC | 89 | GAAUGCCCAACAGGAUAUC | 90 |
| NM_005080_735-753 | CUCCCAGAGGUCUACCCAG | 91 | CUGGGUAGACCUCUGGGAG | 92 |
| NM_005080_753-771 | GAAGGACCCAGUUCCUUAC | 93 | GUAAGGAACUGGGUCCUUC | 94 |
| NM_005080_794-812 | GGGGACGUCAUCAGCCAAG | 95 | CUUGGCUGAUGACGUCCCC | 96 |
| NM_005080_826-844 | AUGAACUAAUUCGUUUUGA | 97 | UCAAAACGAAUUAGUUCAU | 98 |
| NM_005080_836-854 | UCGUUUUGACCACAUAUAU | 99 | AUAUAUGUGGUCAAAACGA | 100 |
| NM_005080_840-858 | UUUGACCACAUAUAUACCA | 101 | UGGUAUAUAUGUGGUCAAA | 102 |
| NM_005080_841-859 | UUGACCACAUAUAUACCAA | 103 | UUGGUAUAUAUGUGGUCAA | 104 |
| NM_005080_847-865 | ACAUAUAUACCAAGCCCCU | 105 | AGGGGCUUGGUAUAUAUGU | 106 |
| NM_005080_894-912 | AGCCAAGCUAAUGUGGUAG | 107 | CUACCACAUUAGCUUGGCU | 108 |
| NM_005080_895-913 | GCCAAGCUAAUGUGGUAGU | 109 | ACUACCACAUUAGCUUGGC | 110 |
| NM_005080_896-914 | CCAAGCUAAUGUGGUAGUG | 111 | CACUACCACAUUAGCUUGG | 112 |
| NM_005080_899-917 | AGCUAAUGUGGUAGUGAAA | 113 | UUUCACUACCACAUUAGCU | 114 |
| NM_005080_908-926 | GGUAGUGAAAAUCGAGGAA | 115 | UUCCUCGAUUUUCACUACC | 116 |
| NM_005080_917-935 | AAUCGAGGAAGCACCUCUC | 117 | GAGAGGUGCUUCCUCGAUU | 118 |
| NM_005080_937-955 | GCCCCUCAGAGAAUGAUCA | 119 | UGAUCAUUCUCUGAGGGGC | 120 |
| NM_005080_950-968 | UGAUCACCCUGAAUUCAUU | 121 | AAUGAAUUCAGGGUGAUCA | 122 |
| NM_005080_1185-1203 | CCCCAGCUGAUUAGUGUCU | 123 | AGACACUAAUCAGCUGGGG | 124 |
| NM_005080_1187-1205 | CCAGCUGAUUAGUGUCUAA | 125 | UUAGACACUAAUCAGCUGG | 126 |
| NM_005080_1153-1171 | CUUGGGAGGACACUUUUGC | 127 | GCAAAAGUGUCCUCCCAAG | 128 |
| NM_005080_1787-1805 | UAAAACUACCCAUGCAAUU | 129 | AAUUGCAUGGGUAGUUUUA | 130 |
| NM_005080_606-624 | CUCCCCAUGGAUUCUGGCG | 131 | CGCCAGAAUCCAUGGGGAG | 132 |
| NM_005080_1019-1037 | UAUCUCAAAUCUGCUUUCA | 133 | UGAAAGCAGAUUUGAGAUA | 134 |
| NM_005080_1072-1090 | UGGAUGCUUACAGUGACUG | 135 | CAGUCACUGUAAGCAUCCA | 136 |
| NM_005080_1228-1246 | CUUUUCCUUGACUAUUACA | 137 | UGUAAUAGUCAAGGAAAAG | 138 |
| NM_005080_1461-1479 | UUUAUCUUAAAAGGGUGGU | 139 | ACCACCCUUUUAAGAUAAA | 140 |
| NM_005080_1495-1513 | ACUUAUUAUGUAAGGGUCA | 141 | UGACCCUUACAUAAUAAGU | 142 |
| NM_005080_1496-1514 | CUUAUUAUGUAAGGGUCAU | 143 | AUGACCCUUACAUAAUAAG | 144 |
| NM_005080_1500-1518 | UUAUGUAAGGGUCAUUAGA | 145 | UCUAAUGACCCUUACAUAA | 146 |
| NM_005080_1644-1662 | CCUGCUGAGGGGGCUCUUU | 147 | AAAGAGCCCCCUCAGCAGG | 148 |
| NM_005080_1708-1726 | AUAGAAAUUUACUAUGUAA | 149 | UUACAUAGUAAAUUUCUAU | 150 |

TABLE 8-continued

XBP-1 human/Rhesus siRNAs

| Oligo Name/<br>Positions on target<br>sequence (5'to 3') | sense (5'-3') | SEQ<br>ID<br>NO: | antisense (5'-3') | SEQ<br>ID<br>NO: |
|---|---|---|---|---|
| NM_005080_302-320 | AGACUGCCAGAGAUCGAAA | 151 | UUUCGAUCUCUGGCAGUCU | 152 |
| NM_005080_607-625 | UCCCCAUGGAUUCUGGCGG | 153 | CCGCCAGAAUCCAUGGGGA | 154 |
| NM_005080_824-842 | UAAUGAACUAAUUCGUUUU | 155 | AAAACGAAUUAGUUCAUUA | 156 |
| NM_005080_953-971 | UCACCCUGAAUUCAUUGUC | 157 | GACAAUGAAUUCAGGGUGA | 158 |
| NM_005080_1011-1029 | GAGCUGGGUAUCUCAAAUC | 159 | GAUUUGAGAUACCCAGCUC | 160 |
| NM_005080_1230-1248 | UUUCCUUGACUAUUACACU | 161 | AGUGUAAUAGUCAAGGAAA | 162 |
| NM_005080_1231-1249 | UUCCUUGACUAUUACACUG | 163 | CAGUGUAAUAGUCAAGGAA | 164 |
| NM_005080_1290-1308 | AAAGCCAAAAUAGAGAGUA | 165 | UACUCUCUAUUUUGGCUUU | 166 |
| NM_005080_1331-1349 | AUUUGUUCAGAUCUCAUAG | 167 | CUAUGAGAUCUGAACAAAU | 168 |
| NM_005080_1460-1478 | UUUUAUCUUAAAAGGGUGG | 169 | CCACCCUUUUAAGAUAAAA | 170 |
| NM_005080_1670-1688 | GUAUACUUCAAGUAAGAUC | 171 | GAUCUUACUUGAAGUAUAC | 172 |
| NM_005080_1671-1689 | UAUACUUCAAGUAAGAUCA | 173 | UGAUCUUACUUGAAGUAUA | 174 |
| NM_005080_1735-1753 | UGGAAUUUUUUCCUGCUAG | 175 | CUAGCAGGAAAAAAUUCCA | 176 |
| NM_005080_1744-1762 | UUCCUGCUAGUGUAGCUUC | 177 | GAAGCUACACUAGCAGGAA | 178 |
| NM_005080_1796-1814 | CCAUGCAAUUAAAAGGUAC | 179 | GUACCUUUUAAUUGCAUGG | 180 |
| NM_005080_343-361 | GAACAGCAAGUGGUAGAUU | 181 | AAUCUACCACUUGCUGUUC | 182 |
| NM_005080_374-392 | ACCAAAAACUUUUGCUAGA | 183 | UCUAGCAAAAGUUUUUGGU | 184 |
| NM_005080_375-393 | CCAAAAACUUUUGCUAGAA | 185 | UUCUAGCAAAAGUUUUUGG | 186 |
| NM_005080_608-626 | CCCCAUGGAUUCUGGCGGU | 187 | ACCGCCAGAAUCCAUGGGG | 188 |
| NM_005080_652-670 | AUAUCCUGUUGGGCAUUCU | 189 | AGAAUGCCCAACAGGAUAU | 190 |
| NM_005080_686-704 | AGUCAUGUUCUUCAAAUGC | 191 | GCAUUUGAAGAACAUGACU | 192 |
| NM_005080_909-927 | GUAGUGAAAAUCGAGGAAG | 193 | CUUCCUCGAUUUUCACUAC | 194 |
| NM_005080_951-969 | GAUCACCCUGAAUUCAUUG | 195 | CAAUGAAUUCAGGGUGAUC | 196 |
| NM_005080_952-970 | AUCACCCUGAAUUCAUUGU | 197 | ACAAUGAAUUCAGGGUGAU | 198 |
| NM_005080_825-843 | AAUGAACUAAUUCGUUUUG | 199 | CAAAACGAAUUAGUUCAUU | 200 |
| NM_005080_1194-1212 | AUUAGUGUCUAAGGAAUGA | 201 | UCAUUCCUUAGACACUAAU | 202 |
| NM_005080_831-849 | CUAAUUCGUUUUGACCACA | 203 | UGUGGUCAAAACGAAUUAG | 204 |
| NM_005080_835-853 | UUCGUUUUGACCACAUAUA | 205 | UAUAUGUGGUCAAAACGAA | 206 |
| NM_005080_869-887 | CUUAGAGAUACCCUCUGAG | 207 | CUCAGAGGGUAUCUCUAAG | 208 |
| NM_005080_1246-1264 | ACUGCCUGGAGGAUAGCAG | 209 | CUGCUAUCCUCCAGGCAGU | 210 |
| NM_005080_1453-1471 | AUUGUACUUUUAUCUUAAA | 211 | UUUAAGAUAAAAGUACAAU | 212 |
| NM_005080_1512-1530 | CAUUAGACAAAUGUCUUGA | 213 | UCAAGACAUUUGUCUAAUG | 214 |
| NM_005080_1546-1564 | UAUGAAUGGUUCUUUAUCA | 215 | UGAUAAAGAACCAUUCAUA | 216 |
| NM_005080_1789-1807 | AAACUACCCAUGCAAUUAA | 217 | UUAAUUGCAUGGGUAGUUU | 218 |
| NM_005080_325-343 | GCUCGAAUGAGUGAGCUGG | 219 | CCAGCUCACUCAUUCGAGC | 220 |
| NM_005080_393-411 | AAAUCAGCUUUUACGAGAG | 221 | CUCUCGUAAAAGCUGAUUU | 222 |

TABLE 8-continued

XBP-1 human/Rhesus siRNAs

| Oligo Name/<br>Positions on target<br>sequence (5' to 3') | sense (5'-3') | SEQ ID NO: | antisense (5'-3') | SEQ ID NO: |
|---|---|---|---|---|
| NM_005080_788-806 | GUCAGUGGGGACGUCAUCA | 223 | UGAUGACGUCCCCACUGAC | 224 |
| NM_005080_821-839 | CAUUAAUGAACUAAUUCGU | 225 | ACGAAUUAGUUCAUUAAUG | 226 |
| NM_005080_1514-1532 | UUAGACAAAUGUCUUGAAG | 227 | CUUCAAGACAUUUGUCUAA | 228 |
| NM_005080_1797-1815 | CAUGCAAUUAAAAGGUACA | 229 | UGUACCUUUUAAUUGCAUG | 230 |
| NM_005080_833-851 | AAUUCGUUUUGACCACAUA | 231 | UAUGUGGUCAAAACGAAUU | 232 |
| NM_005080_1509-1527 | GGUCAUUAGACAAAUGUCU | 233 | AGACAUUUGUCUAAUGACC | 234 |
| NM_005080_1802-1820 | AAUUAAAAGGUACAAUGCA | 235 | UGCAUUGUACCUUUUAAUU | 236 |
| NM_005080_391-409 | GAAAAUCAGCUUUUACGAG | 237 | CUCGUAAAAGCUGAUUUUC | 238 |
| NM_005080_843-861 | GACCACAUAUAUACCAAGC | 239 | GCUUGGUAUAUAUGUGGUC | 240 |
| NM_005080_1508-1526 | GGGUCAUUAGACAAAUGUC | 241 | GACAUUUGUCUAAUGACCC | 242 |
| NM_005080_1754-1772 | UGUAGCUUCUGAAAGGUGC | 243 | GCACCUUUCAGAAGCUACA | 244 |
| NM_005080_430-448 | GUUGAGAACCAGGAGUUAA | 245 | UUAACUCCUGGUUCUCAAC | 246 |
| NM_005080_437-455 | ACCAGGAGUUAAGACAGCG | 247 | CGCUGUCUUAACUCCUGGU | 248 |
| NM_005080_1465-1483 | UCUUAAAAGGGUGGUAGUU | 249 | AACUACCACCCUUUUAAGA | 250 |
| NM_005080_1742-1760 | UUUUCCUGCUAGUGUAGCU | 251 | AGCUACACUAGCAGGAAAA | 252 |
| NM_005080_438-456 | CCAGGAGUUAAGACAGCGC | 253 | GCGCUGUCUUAACUCCUGG | 254 |
| NM_005080_1060-1078 | CUUCCUGCCUACUGGAUGC | 255 | GCAUCCAGUAGGCAGGAAG | 256 |
| NM_005080_1067-1085 | CCUACUGGAUGCUUACAGU | 257 | ACUGUAAGCAUCCAGUAGG | 258 |
| NM_005080_1197-1215 | AGUGUCUAAGGAAUGAUCC | 259 | GGAUCAUUCCUUAGACACU | 260 |
| NM_005080_1198-1216 | GUGUCUAAGGAAUGAUCCA | 261 | UGGAUCAUUCCUUAGACAC | 262 |
| NM_005080_1424-1442 | UACUAUAAUUGAGAACUAC | 263 | GUAGUUCUCAAUUAUAGUA | 264 |
| NM_005080_1464-1482 | AUCUUAAAAGGGUGGUAGU | 265 | ACUACCACCCUUUUAAGAU | 266 |
| NM_005080_616-634 | AUUCUGGCGGUAUUGACUC | 267 | GAGUCAAUACCGCCAGAAU | 268 |
| NM_005080_757-775 | GACCCAGUUCCUUACCAGC | 269 | GCUGGUAAGGAACUGGGUC | 270 |
| NM_005080_785-803 | UCUGUCAGUGGGGACGUCA | 271 | UGACGUCCCCACUGACAGA | 272 |
| NM_005080_819-837 | GCCAUUAAUGAACUAAUUC | 273 | GAAUUAGUUCAUUAAUGGC | 274 |
| NM_005080_842-860 | UGACCACAUAUAUACCAAG | 275 | CUUGGUAUAUAUGUGGUCA | 276 |
| NM_005080_845-863 | CCACAUAUAUACCAAGCCC | 277 | GGGCUUGGUAUAUAUGUGG | 278 |
| NM_005080_1013-1031 | GCUGGGUAUCUCAAAUCUG | 279 | CAGAUUUGAGAUACCCAGC | 280 |
| NM_005080_1431-1449 | AUUGAGAACUACAGCUUUU | 281 | AAAAGCUGUAGUUCUCAAU | 282 |
| NM_005080_1673-1691 | UACUUCAAGUAAGAUCAAG | 283 | CUUGAUCUUACUUGAAGUA | 284 |
| NM_005080_283-301 | AAAAACAGAGUAGCAGCUC | 285 | GAGCUGCUACUCUGUUUUU | 286 |
| NM_005080_838-856 | GUUUUGACCACAUAUAUAC | 287 | GUAUAUAUGUGGUCAAAAC | 288 |
| NM_005080_279-297 | ACUGAAAACAGAGUAGCA | 289 | UGCUACUCUGUUUUCAGU | 290 |
| NM_005080_633-651 | UCUUCAGAUUCAGAGUCUG | 291 | CAGACUCUGAAUCUGAAGA | 292 |
| NM_005080_1024-1042 | CAAAUCUGCUUUCAUCCAG | 293 | CUGGAUGAAAGCAGAUUUG | 294 |
| NM_005080_1147-1165 | ACCAUUCUUGGGAGGACAC | 295 | GUGUCCUCCCAAGAAUGGU | 296 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1154-1172 | UUGGGAGGACACUUUUGCC | 297 | GGCAAAAGUGUCCUCCCAA | 298 |
| NM_005080_1188-1206 | CAGCUGAUUAGUGUCUAAG | 299 | CUUAGACACUAAUCAGCUG | 300 |
| NM_005080_1192-1210 | UGAUUAGUGUCUAAGGAAU | 301 | AUUCCUUAGACACUAAUCA | 302 |
| NM_005080_1195-1213 | UUAGUGUCUAAGGAAUGAU | 303 | AUCAUUCCUUAGACACUAA | 304 |
| NM_005080_1238-1256 | ACUAUUACACUGCCUGGAG | 305 | CUCCAGGCAGUGUAAUAGU | 306 |
| NM_005080_1548-1566 | UGAAUGGUUCUUUAUCAUU | 307 | AAUGAUAAAGAACCAUUCA | 308 |
| NM_005080_1549-1567 | GAAUGGUUCUUUAUCAUUU | 309 | AAAUGAUAAAGAACCAUUC | 310 |
| NM_005080_1677-1695 | UCAAGUAAGAUCAAGAAUC | 311 | GAUUCUUGAUCUUACUUGA | 312 |
| NM_005080_1707-1725 | UAUAGAAAUUUACUAUGUA | 313 | UACAUAGUAAAUUUCUAUA | 314 |
| NM_005080_1713-1731 | AAUUUACUAUGUAAAUGCU | 315 | AGCAUUUACAUAGUAAAUU | 316 |
| NM_005080_1786-1804 | UUAAAACUACCCAUGCAAU | 317 | AUUGCAUGGGUAGUUUUAA | 318 |
| NM_005080_210-228 | GCUGCCCCAGGCGCGCAAG | 319 | CUUGCGCGCCUGGGGCAGC | 320 |
| NM_005080_278-296 | AACUGAAAACAGAGUAGC | 321 | GCUACUCUGUUUUCAGUU | 322 |
| NM_005080_284-302 | AAAACAGAGUAGCAGCUCA | 323 | UGAGCUGCUACUCUGUUUU | 324 |
| NM_005080_290-308 | GAGUAGCAGCUCAGACUGC | 325 | GCAGUCUGAGCUGCUACUC | 326 |
| NM_005080_342-360 | GGAACAGCAAGUGGUAGAU | 327 | AUCUACCACUUGCUGUUCC | 328 |
| NM_005080_431-449 | UUGAGAACCAGGAGUUAAG | 329 | CUUAACUCCUGGUUCUCAA | 330 |
| NM_005080_576-594 | GCAGGCCCAGUUGUCACCC | 331 | GGGUGACAACUGGGCCUGC | 332 |
| NM_005080_602-620 | ACAUCUCCCAUGGAUUCU | 333 | AGAAUCCAUGGGGAGAUGU | 334 |
| NM_005080_618-636 | UCUGGCGGUAUUGACUCUU | 335 | AAGAGUCAAUACCGCCAGA | 336 |
| NM_005080_678-696 | UUGGACCCAGUCAUGUUCU | 337 | AGAACAUGACUGGGUCCAA | 338 |
| NM_005080_796-814 | GGACGUCAUCAGCCAAGCU | 339 | AGCUUGGCUGAUGACGUCC | 340 |
| NM_005080_940-958 | CCUCAGAGAAUGAUCACCC | 341 | GGGUGAUCAUUCUCUGAGG | 342 |
| NM_005080_954-972 | CACCCUGAAUUCAUUGUCU | 343 | AGACAAUGAAUUCAGGGUG | 344 |
| NM_005080_977-995 | GAAGGAAGAACCUGUAGAA | 345 | UUCUACAGGUUCUUCCUUC | 346 |
| NM_005080_1018-1036 | GUAUCUCAAAUCUGCUUUC | 347 | GAAAGCAGAUUUGAGAUAC | 348 |
| NM_005080_1026-1044 | AAUCUGCUUUCAUCCAGCC | 349 | GGCUGGAUGAAAGCAGAUU | 350 |
| NM_005080_1138-1156 | UUGGUGUAAACCAUUCUUG | 351 | CAAGAAUGGUUUACACCAA | 352 |
| NM_005080_1141-1159 | GUGUAAACCAUUCUUGGGA | 353 | UCCCAAGAAUGGUUUACAC | 354 |
| NM_005080_1142-1160 | UGUAAACCAUUCUUGGGAG | 355 | CUCCCAAGAAUGGUUUACA | 356 |
| NM_005080_1155-1173 | UGGGAGGACACUUUUGCCA | 357 | UGGCAAAAGUGUCCUCCCA | 358 |
| NM_005080_1158-1176 | GAGGACACUUUUGCCAAUG | 359 | CAUUGGCAAAAGUGUCCUC | 360 |
| NM_005080_1193-1211 | GAUUAGUGUCUAAGGAAUG | 361 | CAUUCCUUAGACACUAAUC | 362 |
| NM_005080_1196-1214 | UAGUGUCUAAGGAAUGAUC | 363 | GAUCAUUCCUUAGACACUA | 364 |
| NM_005080_1219-1237 | ACUGUUGCCCUUUUCCUUG | 365 | CAAGGAAAAGGGCAACAGU | 366 |
| NM_005080_107-125 | UGUCGGGGCAGCCCGCCUC | 367 | GAGGCGGGCUGCCCCGACA | 368 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_108-126 | GUCGGGCAGCCCGCCUCC | 369 | GGAGGCGGGCUGCCCCGAC | 370 |
| NM_005080_1505-1523 | UAAGGGUCAUUAGACAAAU | 371 | AUUUGUCUAAUGACCCUUA | 372 |
| NM_005080_1567-1585 | UCUCUUCCCCUUUUUGGC | 373 | GCCAAAAAGGGGAAGAGA | 374 |
| NM_005080_1672-1690 | AUACUUCAAGUAAGAUCAA | 375 | UUGAUCUUACUUGAAGUAU | 376 |
| NM_005080_1678-1696 | CAAGUAAGAUCAAGAAUCU | 377 | AGAUUCUUGAUCUUACUUG | 378 |
| NM_005080_1778-1796 | CCAUUUAUUUAAAACUACC | 379 | GGUAGUUUUAAAUAAAUGG | 380 |
| NM_005080_1779-1797 | CAUUUAUUUAAAACUACCC | 381 | GGGUAGUUUUAAAUAAAUG | 382 |
| NM_005080_280-298 | CUGAAAAACAGAGUAGCAG | 383 | CUGCUACUCUGUUUUUCAG | 384 |
| NM_005080_282-300 | GAAAAACAGAGUAGCAGCU | 385 | AGCUGCUACUCUGUUUUUC | 386 |
| NM_005080_288-306 | CAGAGUAGCAGCUCAGACU | 387 | AGUCUGAGCUGCUACUCUG | 388 |
| NM_005080_291-309 | AGUAGCAGCUCAGACUGCC | 389 | GGCAGUCUGAGCUGCUACU | 390 |
| NM_005080_347-365 | AGCAAGUGGUAGAUUUAGA | 391 | UCUAAAUCUACCACUUGCU | 392 |
| NM_005080_397-415 | CAGCUUUUACGAGAGAAAA | 393 | UUUUCUCUCGUAAAAGCUG | 394 |
| NM_005080_398-416 | AGCUUUUACGAGAGAAAAC | 395 | GUUUUCUCUCGUAAAAGCU | 396 |
| NM_005080_399-417 | GCUUUUACGAGAGAAAACU | 397 | AGUUUUCUCUCGUAAAAGC | 398 |
| NM_005080_512-530 | UGAGGCCAGUGGCCGGGUC | 399 | GACCCGGCCACUGGCCUCA | 400 |
| NM_005080_517-535 | CCAGUGGCCGGGUCUGCUG | 401 | CAGCAGACCCGGCCACUGG | 402 |
| NM_005080_596-614 | UCCAGAACAUCUCCCCAUG | 403 | CAUGGGGAGAUGUUCUGGA | 404 |
| NM_005080_598-616 | CAGAACAUCUCCCCAUGGA | 405 | UCCAUGGGGAGAUGUUCUG | 406 |
| NM_005080_601-619 | AACAUCUCCCCAUGGAUUC | 407 | GAAUCCAUGGGGAGAUGUU | 408 |
| NM_005080_605-623 | UCUCCCCAUGGAUUCUGGC | 409 | GCCAGAAUCCAUGGGGAGA | 410 |
| NM_005080_661-679 | UGGGCAUUCUGGACAACUU | 411 | AAGUUGUCCAGAAUGCCCA | 412 |
| NM_005080_688-706 | UCAUGUUCUUCAAAUGCCC | 413 | GGGCAUUUGAAGAACAUGA | 414 |
| NM_005080_691-709 | UGUUCUUCAAAUGCCCUUC | 415 | GAAGGGCAUUUGAAGAACA | 416 |
| NM_005080_828-846 | GAACUAAUUCGUUUUGACC | 417 | GGUCAAAACGAAUUAGUUC | 418 |
| NM_005080_830-848 | ACUAAUUCGUUUUGACCAC | 419 | GUGGUCAAAACGAAUUAGU | 420 |
| NM_005080_834-852 | AUUCGUUUUGACCACAUAU | 421 | AUAUGUGGUCAAAACGAAU | 422 |
| NM_005080_846-864 | CACAUAUAUACCAAGCCCC | 423 | GGGGCUUGGUAUAUAUGUG | 424 |
| NM_005080_870-888 | UUAGAGAUACCCUCUGAGA | 425 | UCUCAGAGGGUAUCUCUAA | 426 |
| NM_005080_891-909 | GAGAGCCAAGCUAAUGUGG | 427 | CCACAUUAGCUUGGCUCUC | 428 |
| NM_005080_900-918 | GCUAAUGUGGUAGUGAAAA | 429 | UUUUCACUACCACAUUAGC | 430 |
| NM_005080_911-929 | AGUGAAAAUCGAGGAAGCA | 431 | UGCUUCCUCGAUUUUCACU | 432 |
| NM_005080_912-930 | GUGAAAAUCGAGGAAGCAC | 433 | GUGCUUCCUCGAUUUUCAC | 434 |
| NM_005080_979-997 | AGGAAGAACCUGUAGAAGA | 435 | UCUUCUACAGGUUCUUCCU | 436 |
| NM_005080_1366-1384 | GUCUUUUGACAUCCAGCAG | 437 | CUGCUGGAUGUCAAAAGAC | 438 |
| NM_005080_150-168 | GGCCCUGCCGCUCAUGGUG | 439 | CACCAUGAGCGGCAGGGCC | 440 |
| NM_005080_1437-1455 | AACUACAGCUUUUAAGAUU | 441 | AAUCUUAAAAGCUGUAGUU | 442 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_482-500 | AAGAGGAGGCGGAAGCCAA | 443 | TTGGCTTCCGCCTCCTCTT | 444 |
| NM_005080_580-598 | GCCCAGUUGUCACCCCUCC | 445 | GGAGGGGUGACAACUGGGC | 446 |
| NM_005080_613-631 | UGGAUUCUGGCGGUAUUGA | 447 | UCAAUACCGCCAGAAUCCA | 448 |
| NM_005080_1065-1083 | UGCCUACUGGAUGCUUACA | 449 | UGUAAGCAUCCAGUAGGCA | 450 |
| NM_005080_614-632 | GGAUUCUGGCGGUAUUGAC | 451 | GUCAAUACCGCCAGAAUCC | 452 |
| NM_005080_640-658 | AUUCAGAGUCUGAUAUCCU | 453 | AGGAUAUCAGACUCUGAAU | 454 |
| NM_005080_1014-1032 | CUGGGUAUCUCAAAUCUGC | 455 | GCAGAUUUGAGAUACCCAG | 456 |
| NM_005080_1015-1033 | UGGGUAUCUCAAAUCUGCU | 457 | AGCAGAUUUGAGAUACCCA | 458 |
| NM_005080_1146-1164 | AACCAUUCUUGGGAGGACA | 459 | UGUCCUCCCAAGAAUGGUU | 460 |
| NM_005080_1232-1250 | UCCUUGACUAUUACACUGC | 461 | GCAGUGUAAUAGUCAAGGA | 462 |
| NM_005080_1234-1252 | CUUGACUAUUACACUGCCU | 463 | AGGCAGUGUAAUAGUCAAG | 464 |
| NM_005080_1237-1255 | GACUAUUACACUGCCUGGA | 465 | UCCAGGCAGUGUAAUAGUC | 466 |
| NM_005080_1443-1461 | AGCUUUUAAGAUUGUACUU | 467 | AAGUACAAUCUUAAAAGCU | 468 |
| NM_005080_1462-1480 | UUAUCUUAAAAGGGUGGUA | 469 | UACCACCCUUUUAAGAUAA | 470 |
| NM_005080_1510-1528 | GUCAUUAGACAAAUGUCUU | 471 | AAGACAUUUGUCUAAUGAC | 472 |
| NM_005080_1591-1609 | GGCUUGCCUCCAGUUUUAG | 473 | CUAAAACUGGAGGCAAGCC | 474 |
| NM_005080_1615-1633 | UUAGUUUGCUUCUGUAAGC | 475 | GCUUACAGAAGCAAACUAA | 476 |
| NM_005080_1716-1734 | UUACUAUGUAAAUGCUUGA | 477 | UCAAGCAUUUACAUAGUAA | 478 |
| NM_005080_1718-1736 | ACUAUGUAAAUGCUUGAUG | 479 | CAUCAAGCAUUUACAUAGU | 480 |
| NM_005080_1725-1743 | AAAUGCUUGAUGGAAUUUU | 481 | AAAAUUCCAUCAAGCAUUU | 482 |
| NM_005080_1748-1766 | UGCUAGUGUAGCUUCUGAA | 483 | UUCAGAAGCUACACUAGCA | 484 |
| NM_005080_1780-1798 | AUUUAUUUAAAACUACCCA | 485 | UGGGUAGUUUUAAAUAAAU | 486 |
| NM_005080_1794-1812 | ACCCAUGCAAUUAAAAGGU | 487 | ACCUUUUAAUUGCAUGGGU | 488 |
| NM_005080_156-174 | GCCGCUCAUGGUGCCAGCC | 489 | GGCUGGCACCAUGAGCGGC | 490 |
| NM_005080_299-317 | CUCAGACUGCCAGAGAUCG | 491 | CGAUCUCUGGCAGUCUGAG | 492 |
| NM_005080_344-362 | AACAGCAAGUGGUAGAUUU | 493 | AAAUCUACCACUUGCUGUU | 494 |
| NM_005080_371-389 | AGAACCAAAAACUUUUGCU | 495 | AGCAAAAGUUUUUGGUUCU | 496 |
| NM_005080_373-391 | AACCAAAAACUUUUGCUAG | 497 | CUAGCAAAAGUUUUUGGUU | 498 |
| NM_005080_524-542 | CCGGGUCUGCUGAGUCCGC | 499 | GCGGACUCAGCAGACCCGG | 500 |
| NM_005080_525-543 | CGGGUCUGCUGAGUCCGCA | 501 | UGCGGACUCAGCAGACCCG | 502 |
| NM_005080_612-630 | AUGGAUUCUGGCGGUAUUG | 503 | CAAUACCGCCAGAAUCCAU | 504 |
| NM_005080_615-633 | GAUUCUGGCGGUAUUGACU | 505 | AGUCAAUACCGCCAGAAUC | 506 |
| NM_005080_645-663 | GAGUCUGAUAUCCUGUUGG | 507 | CCAACAGGAUAUCAGACUC | 508 |
| NM_005080_792-810 | GUGGGGACGUCAUCAGCCA | 509 | UGGCUGAUGACGUCCCCAC | 510 |
| NM_005080_905-923 | UGUGGUAGUGAAAUCGAG | 511 | CUCGAUUUCACUACCACA | 512 |
| NM_005080_976-994 | UGAAGGAAGAACCUGUAGA | 513 | UCUACAGGUUCUUCCUUCA | 514 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_1244-1262 | ACACUGCCUGGAGGAUAGC | 515 | GCUAUCCUCCAGGCAGUGU | 516 |
| NM_005080_1791-1809 | ACUACCCAUGCAAUUAAAA | 517 | UUUUAAUUGCAUGGGUAGU | 518 |
| NM_005080_755-773 | AGGACCCAGUUCCUUACCA | 519 | UGGUAAGGAACUGGGUCCU | 520 |
| NM_005080_799-817 | CGUCAUCAGCCAAGCUGGA | 521 | UCCAGCUUGGCUGAUGACG | 522 |
| NM_005080_832-850 | UAAUUCGUUUUGACCACAU | 523 | AUGUGGUCAAAACGAAUUA | 524 |
| NM_005080_839-857 | UUUUGACCACAUAUAUACC | 525 | GGUAUAUAUGUGGUCAAAA | 526 |
| NM_005080_100-118 | CUGCUUCUGUCGGGCAGC | 527 | GCUGCCCCGACAGAAGCAG | 528 |
| NM_005080_281-299 | UGAAAACAGAGUAGCAGC | 529 | GCUGCUACUCUGUUUUUCA | 530 |
| NM_005080_822-840 | AUUAAUGAACUAAUUCGUU | 531 | AACGAAUUAGUUCAUUAAU | 532 |
| NM_005080_1152-1170 | UCUUGGGAGGACACUUUUG | 533 | CAAAAGUGUCCUCCCAAGA | 534 |
| NM_005080_1191-1209 | CUGAUUAGUGUCUAAGGAA | 535 | UUCCUUAGACACUAAUCAG | 536 |
| NM_005080_1225-1243 | GCCCUUUUCCUUGACUAUU | 537 | AAUAGUCAAGGAAAAGGGC | 538 |
| NM_005080_1227-1245 | CCUUUUCCUUGACUAUUAC | 539 | GUAAUAGUCAAGGAAAAGG | 540 |
| NM_005080_1239-1257 | CUAUUACACUGCCUGGAGG | 541 | CCUCCAGGCAGUGUAAUAG | 542 |
| NM_005080_1430-1448 | AAUUGAGAACUACAGCUUU | 543 | AAAGCUGUAGUUCUCAAUU | 544 |
| NM_005080_1499-1517 | AUUAUGUAAGGGUCAUUAG | 545 | CUAAUGACCCUUACAUAAU | 546 |
| NM_005080_1553-1571 | GGUUCUUUAUCAUUUCUCU | 547 | AGAGAAAUGAUAAAGAACC | 548 |
| NM_005080_1585-1603 | CAUCCUGGCUUGCCUCCAG | 549 | CUGGAGGCAAGCCAGGAUG | 550 |
| NM_005080_1592-1610 | GCUUGCCUCCAGUUUUAGG | 551 | CCUAAAACUGGAGGCAAGC | 552 |
| NM_005080_1743-1761 | UUUCCUGCUAGUGUAGCUU | 553 | AAGCUACACUAGCAGGAAA | 554 |
| NM_005080_154-172 | CUGCCGCUCAUGGUGCCAG | 555 | CUGGCACCAUGAGCGGCAG | 556 |
| NM_005080_193-211 | GAGGCAGCGAGCGGGGGC | 557 | GCCCCCGCUCGCUGCCUC | 558 |
| NM_005080_199-217 | GCGAGCGGGGGCUGCCCC | 559 | GGGGCAGCCCCCGCUCGC | 560 |
| NM_005080_292-310 | GUAGCAGCUCAGACUGCCA | 561 | UGGCAGUCUGAGCUGCUAC | 562 |
| NM_005080_341-359 | UGGAACAGCAAGUGGUAGA | 563 | UCUACCACUUGCUGUUCCA | 564 |
| NM_005080_377-395 | AAAAACUUUUGCUAGAAAA | 565 | UUUUCUAGCAAAAGUUUUU | 566 |
| NM_005080_519-537 | AGUGGCCGGGUCUGCUGAG | 567 | CUCAGCAGACCCGGCCACU | 568 |
| NM_005080_522-540 | GGCCGGGUCUGCUGAGUCC | 569 | GGACUCAGCAGACCCGGCC | 570 |
| NM_005080_577-595 | CAGGCCCAGUUGUCACCCC | 571 | GGGGUGACAACUGGGCCUG | 572 |
| NM_005080_599-617 | AGAACAUCUCCCCAUGGAU | 573 | AUCCAUGGGGAGAUGUUCU | 574 |
| NM_005080_754-772 | AAGGACCCAGUUCCUUACC | 575 | GGUAAGGAACUGGGUCCUU | 576 |
| NM_005080_888-906 | ACAGAGAGCCAAGCUAAUG | 577 | CAUUAGCUUGGCUCUCUGU | 578 |
| NM_005080_939-957 | CCCUCAGAGAAUGAUCACC | 579 | GGUGAUCAUUCUCUGAGGG | 580 |
| NM_005080_964-982 | UCAUUGUCUCAGUGAAGGA | 581 | UCCUUCACUGAGACAAUGA | 582 |
| NM_005080_1012-1030 | AGCUGGGUAUCUCAAAUCU | 583 | AGAUUUGAGAUACCCAGCU | 584 |
| NM_005080_1016-1034 | GGGUAUCUCAAAUCUGCUU | 585 | AAGCAGAUUUGAGAUACCC | 586 |
| NM_005080_1020-1038 | AUCUCAAAUCUGCUUUCAU | 587 | AUGAAAGCAGAUUUGAGAU | 588 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_1025-1043 | AAAUCUGCUUUCAUCCAGC | 589 | GCUGGAUGAAAGCAGAUUU | 590 |
| NM_005080_1027-1045 | AUCUGCUUUCAUCCAGCCA | 591 | UGGCUGGAUGAAAGCAGAU | 592 |
| NM_005080_1028-1046 | UCUGCUUUCAUCCAGCCAC | 593 | GUGGCUGGAUGAAAGCAGA | 594 |
| NM_005080_1030-1048 | UGCUUUCAUCCAGCCACUG | 595 | CAGUGGCUGGAUGAAAGCA | 596 |
| NM_005080_1031-1049 | GCUUUCAUCCAGCCACUGC | 597 | GCAGUGGCUGGAUGAAAGC | 598 |
| NM_005080_1032-1050 | CUUUCAUCCAGCCACUGCC | 599 | GGCAGUGGCUGGAUGAAAG | 600 |
| NM_005080_1033-1051 | UUUCAUCCAGCCACUGCCC | 601 | GGGCAGUGGCUGGAUGAAA | 602 |
| NM_005080_1056-1074 | CCAUCUUCCUGCCUACUGG | 603 | CCAGUAGGCAGGAAGAUGG | 604 |
| NM_005080_1057-1075 | CAUCUUCCUGCCUACUGGA | 605 | UCCAGUAGGCAGGAAGAUG | 606 |
| NM_005080_1058-1076 | AUCUUCCUGCCUACUGGAU | 607 | AUCCAGUAGGCAGGAAGAU | 608 |
| NM_005080_1059-1077 | UCUUCCUGCCUACUGGAUG | 609 | CAUCCAGUAGGCAGGAAGA | 610 |
| NM_005080_1061-1079 | UUCCUGCCUACUGGAUGCU | 611 | AGCAUCCAGUAGGCAGGAA | 612 |
| NM_005080_1063-1081 | CCUGCCUACUGGAUGCUUA | 613 | UAAGCAUCCAGUAGGCAGG | 614 |
| NM_005080_1069-1087 | UACUGGAUGCUUACAGUGA | 615 | UCACUGUAAGCAUCCAGUA | 616 |
| NM_005080_1071-1089 | CUGGAUGCUUACAGUGACU | 617 | AGUCACUGUAAGCAUCCAG | 618 |
| NM_005080_1073-1091 | GGAUGCUUACAGUGACUGU | 619 | ACAGUCACUGUAAGCAUCC | 620 |
| NM_005080_1075-1093 | AUGCUUACAGUGACUGUGG | 621 | CCACAGUCACUGUAAGCAU | 622 |
| NM_005080_1076-1094 | UGCUUACAGUGACUGUGGA | 623 | UCCACAGUCACUGUAAGCA | 624 |
| NM_005080_1078-1096 | CUUACAGUGACUGUGGAUA | 625 | UAUCCACAGUCACUGUAAG | 626 |
| NM_005080_1139-1157 | UGGUGUAAACCAUUCUUGG | 627 | CCAAGAAUGGUUUACACCA | 628 |
| NM_005080_1140-1158 | GGUGUAAACCAUUCUUGGG | 629 | CCCAAGAAUGGUUUACACC | 630 |
| NM_005080_1143-1161 | GUAAACCAUUCUUGGGAGG | 631 | CCUCCCAAGAAUGGUUUAC | 632 |
| NM_005080_1144-1162 | UAAACCAUUCUUGGGAGGA | 633 | UCCUCCCAAGAAUGGUUUA | 634 |
| NM_005080_1145-1163 | AAACCAUUCUUGGGAGGAC | 635 | GUCCUCCCAAGAAUGGUUU | 636 |
| NM_005080_1148-1166 | CCAUUCUUGGGAGGACACU | 637 | AGUGUCCUCCCAAGAAUGG | 638 |
| NM_005080_1156-1174 | GGGAGGACACUUUUGCCAA | 639 | UUGGCAAAAGUGUCCUCCC | 640 |
| NM_005080_1157-1175 | GGAGGACACUUUUGCCAAU | 641 | AUUGGCAAAAGUGUCCUCC | 642 |
| NM_005080_1159-1177 | AGGACACUUUUGCCAAUGA | 643 | UCAUUGGCAAAAGUGUCCU | 644 |
| NM_005080_1160-1178 | GGACACUUUUGCCAAUGAA | 645 | UUCAUUGGCAAAAGUGUCC | 646 |
| NM_005080_1190-1208 | GCUGAUUAGUGUCUAAGGA | 647 | UCCUUAGACACUAAUCAGC | 648 |
| NM_005080_1218-1236 | UACUGUUGCCCUUUUCCUU | 649 | AAGGAAAAGGGCAACAGUA | 650 |
| NM_005080_1220-1238 | CUGUUGCCCUUUUCCUUGA | 651 | UCAAGGAAAAGGGCAACAG | 652 |
| NM_005080_1221-1239 | UGUUGCCCUUUUCCUUGAC | 653 | GUCAAGGAAAAGGGCAACA | 654 |
| NM_005080_1233-1251 | CCUUGACUAUUACACUGCC | 655 | GGCAGUGUAAUAGUCAAGG | 656 |
| NM_005080_1240-1258 | UAUUACACUGCCUGGAGGA | 657 | UCCUCCAGGCAGUGUAAUA | 658 |
| NM_005080_1241-1259 | AUUACACUGCCUGGAGGAU | 659 | AUCCUCCAGGCAGUGUAAU | 660 |

TABLE 8-continued

XBP-1 human/Rhesus siRNAs

| Oligo Name/<br>Positions on target<br>sequence (5'to 3') | sense (5'-3') | SEQ<br>ID<br>NO: | antisense (5'-3') | SEQ<br>ID<br>NO: |
|---|---|---|---|---|
| NM_005080_1242-1260 | UUACACUGCCUGGAGGAUA | 661 | UAUCCUCCAGGCAGUGUAA | 662 |
| NM_005080_1243-1261 | UACACUGCCUGGAGGAUAG | 663 | CUAUCCUCCAGGCAGUGUA | 664 |
| NM_005080_1282-1300 | UCAUUCAAAAAGCCAAAAU | 665 | AUUUUGGCUUUUUGAAUGA | 666 |
| NM_005080_1287-1305 | CAAAAGCCAAAAUAGAGA | 667 | UCUCUAUUUUGGCUUUUG | 668 |
| NM_005080_1289-1307 | AAAAGCCAAAAUAGAGAGU | 669 | ACUCUCUAUUUUGGCUUUU | 670 |
| NM_005080_1310-1328 | ACAGUCCUAGAGAAUUCCU | 671 | AGGAAUUCUCUAGGACUGU | 672 |
| NM_005080_1330-1348 | UAUUUGUUCAGAUCUCAUA | 673 | UAUGAGAUCUGAACAAAUA | 674 |
| NM_005080_1332-1350 | UUUGUUCAGAUCUCAUAGA | 675 | UCUAUGAGAUCUGAACAAA | 676 |
| NM_005080_1333-1351 | UUGUUCAGAUCUCAUAGAU | 677 | AUCUAUGAGAUCUGAACAA | 678 |
| NM_005080_1369-1387 | UUUUGACAUCCAGCAGUCC | 679 | GGACUGCUGGAUGUCAAAA | 680 |
| NM_005080_1370-1388 | UUUGACAUCCAGCAGUCCA | 681 | UGGACUGCUGGAUGUCAAA | 682 |
| NM_005080_1371-1389 | UUGACAUCCAGCAGUCCAA | 683 | UUGGACUGCUGGAUGUCAA | 684 |
| NM_005080_101-119 | UGCUUCUGUCGGGCAGCC | 685 | GGCUGCCCCGACAGAAGCA | 686 |
| NM_005080_1418-1436 | AAAUAUUACUAUAAUUGAG | 687 | CUCAAUUAUAGUAAUAUUU | 688 |
| NM_005080_1419-1437 | AAUAUUACUAUAAUUGAGA | 689 | UCUCAAUUAUAGUAAUAUU | 690 |
| NM_005080_1422-1440 | AUUACUAUAAUUGAGAACU | 691 | AGUUCUCAAUUAUAGUAAU | 692 |
| NM_005080_102-120 | GCUUCUGUCGGGCAGCCC | 693 | GGGCUGCCCCGACAGAAGC | 694 |
| NM_005080_1423-1441 | UUACUAUAAUUGAGAACUA | 695 | UAGUUCUCAAUUAUAGUAA | 696 |
| NM_005080_1425-1443 | ACUAUAAUUGAGAACUACA | 697 | UGUAGUUCUCAAUUAUAGU | 698 |
| NM_005080_1427-1445 | UAUAAUUGAGAACUACAGC | 699 | GCUGUAGUUCUCAAUUAUA | 700 |
| NM_005080_1428-1446 | AUAAUUGAGAACUACAGCU | 701 | AGCUGUAGUUCUCAAUUAU | 702 |
| NM_005080_1429-1447 | UAAUUGAGAACUACAGCUU | 703 | AAGCUGUAGUUCUCAAUUA | 704 |
| NM_005080_1432-1450 | UUGAGAACUACAGCUUUUA | 705 | UAAAAGCUGUAGUUCUCAA | 706 |
| NM_005080_1433-1451 | UGAGAACUACAGCUUUUAA | 707 | UUAAAAGCUGUAGUUCUCA | 708 |
| NM_005080_1435-1453 | AGAACUACAGCUUUUAAGA | 709 | UCUUAAAAGCUGUAGUUCU | 710 |
| NM_005080_1439-1457 | CUACAGCUUUUAAGAUUGU | 711 | ACAAUCUUAAAAGCUGUAG | 712 |
| NM_005080_104-122 | UUCUGUCGGGCAGCCCGC | 713 | GCGGGCUGCCCCGACAGAA | 714 |
| NM_005080_1444-1462 | GCUUUUAAGAUUGUACUUU | 715 | AAAGUACAAUCUUAAAAGC | 716 |
| NM_005080_1445-1463 | CUUUUAAGAUUGUACUUUU | 717 | AAAAGUACAAUCUUAAAAG | 718 |
| NM_005080_1446-1464 | UUUUAAGAUUGUACUUUUA | 719 | UAAAAGUACAAUCUUAAAA | 720 |
| NM_005080_1447-1465 | UUUAAGAUUGUACUUUUAU | 721 | AUAAAAGUACAAUCUUAAA | 722 |
| NM_005080_1448-1466 | UUAAGAUUGUACUUUUAUC | 723 | GAUAAAAGUACAAUCUUAA | 724 |
| NM_005080_1451-1469 | AGAUUGUACUUUUAUCUUA | 725 | UAAGAUAAAAGUACAAUCU | 726 |
| NM_005080_1454-1472 | UUGUACUUUUAUCUUAAAA | 727 | UUUUAAGAUAAAAGUACAA | 728 |
| NM_005080_1458-1476 | ACUUUUAUCUUAAAAGGGU | 729 | ACCCUUUUAAGAUAAAAGU | 730 |
| NM_005080_1459-1477 | CUUUUAUCUUAAAAGGGUG | 731 | CACCCUUUUAAGAUAAAAG | 732 |
| NM_005080_106-124 | CUGUCGGGCAGCCCGCCU | 733 | AGGCGGGCUGCCCCGACAG | 734 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1466-1484 | CUUAAAAGGGUGGUAGUUU | 735 | AAACUACCACCCUUUUAAG | 736 |
| NM_005080_1486-1504 | CCCUAAAAUACUUAUUAUG | 737 | CAUAAUAAGUAUUUUAGGG | 738 |
| NM_005080_1487-1505 | CCUAAAAUACUUAUUAUGU | 739 | ACAUAAUAAGUAUUUUAGG | 740 |
| NM_005080_1489-1507 | UAAAAUACUUAUUAUGUAA | 741 | UUACAUAAUAAGUAUUUUA | 742 |
| NM_005080_1490-1508 | AAAAUACUUAUUAUGUAAG | 743 | CUUACAUAAUAAGUAUUUU | 744 |
| NM_005080_1491-1509 | AAAUACUUAUUAUGUAAGG | 745 | CCUUACAUAAUAAGUAUUU | 746 |
| NM_005080_109-127 | UCGGGGCAGCCCGCCUCCG | 747 | CGGAGGCGGGCUGCCCCGA | 748 |
| NM_005080_1497-1515 | UUAUUAUGUAAGGGUCAUU | 749 | AAUGACCCUUACAUAAUAA | 750 |
| NM_005080_1498-1516 | UAUUAUGUAAGGGUCAUUA | 751 | UAAUGACCCUUACAUAAUA | 752 |
| NM_005080_110-128 | CGGGGCAGCCCGCCUCCGC | 753 | GCGGAGGCGGGCUGCCCCG | 754 |
| NM_005080_1511-1529 | UCAUUAGACAAAUGUCUUG | 755 | CAAGACAUUUGUCUAAUGA | 756 |
| NM_005080_1513-1531 | AUUAGACAAAUGUCUUGAA | 757 | UUCAAGACAUUUGUCUAAU | 758 |
| NM_005080_1516-1534 | AGACAAAUGUCUUGAAGUA | 759 | UACUUCAAGACAUUUGUCU | 760 |
| NM_005080_1517-1535 | GACAAAUGUCUUGAAGUAG | 761 | CUACUUCAAGACAUUUGUC | 762 |
| NM_005080_1518-1536 | ACAAAUGUCUUGAAGUAGA | 763 | UCUACUUCAAGACAUUUGU | 764 |
| NM_005080_1547-1565 | AUGAAUGGUUCUUUAUCAU | 765 | AUGAUAAAGAACCAUUCAU | 766 |
| NM_005080_1550-1568 | AAUGGUUCUUUAUCAUUUC | 767 | GAAAUGAUAAAGAACCAUU | 768 |
| NM_005080_1551-1569 | AUGGUUCUUUAUCAUUUCU | 769 | AGAAAUGAUAAAGAACCAU | 770 |
| NM_005080_1552-1570 | UGGUUCUUUAUCAUUUCUC | 771 | GAGAAAUGAUAAAGAACCA | 772 |
| NM_005080_1554-1572 | GUUCUUUAUCAUUUCUCUU | 773 | AAGAGAAAUGAUAAAGAAC | 774 |
| NM_005080_1559-1577 | UUAUCAUUUCUCUUCCCCC | 775 | GGGGGAAGAGAAAUGAUAA | 776 |
| NM_005080_1560-1578 | UAUCAUUUCUCUUCCCCCU | 777 | AGGGGGAAGAGAAAUGAUA | 778 |
| NM_005080_1563-1581 | CAUUUCUCUUCCCCCUUUU | 779 | AAAAGGGGGAAGAGAAAUG | 780 |
| NM_005080_1565-1583 | UUUCUCUUCCCCCUUUUUG | 781 | CAAAAAGGGGGAAGAGAAA | 782 |
| NM_005080_1566-1584 | UUCUCUUCCCCCUUUUUGG | 783 | CCAAAAAGGGGGAAGAGAA | 784 |
| NM_005080_1570-1588 | CUUCCCCCUUUUUGGCAUC | 785 | GAUGCCAAAAAGGGGGAAG | 786 |
| NM_005080_1573-1591 | CCCCCUUUUUGGCAUCCUG | 787 | CAGGAUGCCAAAAAGGGGG | 788 |
| NM_005080_1578-1596 | UUUUUGGCAUCCUGGCUUG | 789 | CAAGCCAGGAUGCCAAAAA | 790 |
| NM_005080_1579-1597 | UUUUGGCAUCCUGGCUUGC | 791 | GCAAGCCAGGAUGCCAAAA | 792 |
| NM_005080_1580-1598 | UUUGGCAUCCUGGCUUGCC | 793 | GGCAAGCCAGGAUGCCAAA | 794 |
| NM_005080_1581-1599 | UUGGCAUCCUGGCUUGCCU | 795 | AGGCAAGCCAGGAUGCCAA | 796 |
| NM_005080_1583-1601 | GGCAUCCUGGCUUGCCUCC | 797 | GGAGGCAAGCCAGGAUGCC | 798 |
| NM_005080_1584-1602 | GCAUCCUGGCUUGCCUCCA | 799 | UGGAGGCAAGCCAGGAUGC | 800 |
| NM_005080_1586-1604 | AUCCUGGCUUGCCUCCAGU | 801 | ACUGGAGGCAAGCCAGGAU | 802 |
| NM_005080_1589-1607 | CUGGCUUGCCUCCAGUUUU | 803 | AAAACUGGAGGCAAGCCAG | 804 |
| NM_005080_1590-1608 | UGGCUUGCCUCCAGUUUUA | 805 | UAAAACUGGAGGCAAGCCA | 806 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1595-1613 | UGCCUCCAGUUUUAGGUCC | 807 | GGACCUAAAACUGGAGGCA | 808 |
| NM_005080_1616-1634 | UAGUUUGCUUCUGUAAGCA | 809 | UGCUUACAGAAGCAAACUA | 810 |
| NM_005080_1617-1635 | AGUUUGCUUCUGUAAGCAA | 811 | UUGCUUACAGAAGCAAACU | 812 |
| NM_005080_1643-1661 | ACCUGCUGAGGGGGCUCUU | 813 | AAGAGCCCCCUCAGCAGGU | 814 |
| NM_005080_1645-1663 | CUGCUGAGGGGGCUCUUUC | 815 | GAAAGAGCCCCCUCAGCAG | 816 |
| NM_005080_1646-1664 | UGCUGAGGGGGCUCUUUCC | 817 | GGAAAGAGCCCCCUCAGCA | 818 |
| NM_005080_1647-1665 | GCUGAGGGGGCUCUUUCCC | 819 | GGGAAAGAGCCCCCUCAGC | 820 |
| NM_005080_1648-1666 | CUGAGGGGGCUCUUUCCCU | 821 | AGGGAAAGAGCCCCCUCAG | 822 |
| NM_005080_1649-1667 | UGAGGGGGCUCUUUCCCUC | 823 | GAGGGAAAGAGCCCCCUCA | 824 |
| NM_005080_1679-1697 | AAGUAAGAUCAAGAAUCUU | 825 | AAGAUUCUUGAUCUUACUU | 826 |
| NM_005080_1680-1698 | AGUAAGAUCAAGAAUCUUU | 827 | AAAGAUUCUUGAUCUUACU | 828 |
| NM_005080_1681-1699 | GUAAGAUCAAGAAUCUUUU | 829 | AAAAGAUUCUUGAUCUUAC | 830 |
| NM_005080_1682-1700 | UAAGAUCAAGAAUCUUUUG | 831 | CAAAAGAUUCUUGAUCUUA | 832 |
| NM_005080_1683-1701 | AAGAUCAAGAAUCUUUUGU | 833 | ACAAAAGAUUCUUGAUCUU | 834 |
| NM_005080_1684-1702 | AGAUCAAGAAUCUUUUGUG | 835 | CACAAAAGAUUCUUGAUCU | 836 |
| NM_005080_1687-1705 | UCAAGAAUCUUUUGUGAAA | 837 | UUUCACAAAAGAUUCUUGA | 838 |
| NM_005080_1709-1727 | UAGAAAUUUACUAUGUAAA | 839 | UUUACAUAGUAAAUUUCUA | 840 |
| NM_005080_1710-1728 | AGAAAUUUACUAUGUAAAU | 841 | AUUUACAUAGUAAAUUUCU | 842 |
| NM_005080_1711-1729 | GAAAUUUACUAUGUAAAUG | 843 | CAUUUACAUAGUAAAUUUC | 844 |
| NM_005080_1712-1730 | AAAUUUACUAUGUAAAUGC | 845 | GCAUUUACAUAGUAAAUUU | 846 |
| NM_005080_1714-1732 | AUUUACUAUGUAAAUGCUU | 847 | AAGCAUUUACUAGUAAAU | 848 |
| NM_005080_1715-1733 | UUUACUAUGUAAAUGCUUG | 849 | CAAGCAUUUACAUAGUAAA | 850 |
| NM_005080_1717-1735 | UACUAUGUAAAUGCUUGAU | 851 | AUCAAGCAUUUACAUAGUA | 852 |
| NM_005080_1719-1737 | CUAUGUAAAUGCUUGAUGG | 853 | CCAUCAAGCAUUUACAUAG | 854 |
| NM_005080_1721-1739 | AUGUAAAUGCUUGAUGGAA | 855 | UUCCAUCAAGCAUUUACAU | 856 |
| NM_005080_1722-1740 | UGUAAAUGCUUGAUGGAAU | 857 | AUUCCAUCAAGCAUUUACA | 858 |
| NM_005080_1723-1741 | GUAAAUGCUUGAUGGAAUU | 859 | AAUUCCAUCAAGCAUUUAC | 860 |
| NM_005080_1726-1744 | AAUGCUUGAUGGAAUUUUU | 861 | AAAAAUUCCAUCAAGCAUU | 862 |
| NM_005080_1727-1745 | AUGCUUGAUGGAAUUUUUU | 863 | AAAAAAUUCCAUCAAGCAU | 864 |
| NM_005080_1728-1746 | UGCUUGAUGGAAUUUUUUC | 865 | GAAAAAAUUCCAUCAAGCA | 866 |
| NM_005080_1729-1747 | GCUUGAUGGAAUUUUUUCC | 867 | GGAAAAAAUUCCAUCAAGC | 868 |
| NM_005080_1736-1754 | GGAAUUUUUUCCUGCUAGU | 869 | ACUAGCAGGAAAAAAUUCC | 870 |
| NM_005080_1739-1757 | AUUUUUUCCUGCUAGUGUA | 871 | UACACUAGCAGGAAAAAAU | 872 |
| NM_005080_1746-1764 | CCUGCUAGUGUAGCUUCUG | 873 | CAGAAGCUACACUAGCAGG | 874 |
| NM_005080_1747-1765 | CUGCUAGUGUAGCUUCUGA | 875 | UCAGAAGCUACACUAGCAG | 876 |
| NM_005080_1749-1767 | GCUAGUGUAGCUUCUGAAA | 877 | UUUCAGAAGCUACACUAGC | 878 |
| NM_005080_1750-1768 | CUAGUGUAGCUUCUGAAAG | 879 | CUUUCAGAAGCUACACUAG | 880 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1751-1769 | UAGUGUAGCUUCUGAAAGG | 881 | CCUUUCAGAAGCUACACUA | 882 |
| NM_005080_1752-1770 | AGUGUAGCUUCUGAAAGGU | 883 | ACCUUUCAGAAGCUACACU | 884 |
| NM_005080_1753-1771 | GUGUAGCUUCUGAAAGGUG | 885 | CACCUUUCAGAAGCUACAC | 886 |
| NM_005080_1755-1773 | GUAGCUUCUGAAAGGUGCU | 887 | AGCACCUUUCAGAAGCUAC | 888 |
| NM_005080_1758-1776 | GCUUCUGAAAGGUGCUUUC | 889 | GAAAGCACCUUUCAGAAGC | 890 |
| NM_005080_1781-1799 | UUUAUUUAAAACUACCCAU | 891 | AUGGGUAGUUUUAAAUAAA | 892 |
| NM_005080_1782-1800 | UUAUUUAAAACUACCCAUG | 893 | CAUGGGUAGUUUUAAAUAA | 894 |
| NM_005080_1784-1802 | AUUUAAAACUACCCAUGCA | 895 | UGCAUGGGUAGUUUUAAAU | 896 |
| NM_005080_1785-1803 | UUUAAAACUACCCAUGCAA | 897 | UUGCAUGGGUAGUUUUAAA | 898 |
| NM_005080_1788-1806 | AAAACUACCCAUGCAAUUA | 899 | UAAUUGCAUGGGUAGUUUU | 900 |
| NM_005080_1792-1810 | CUACCCAUGCAAUUAAAAG | 901 | CUUUUAAUUGCAUGGGUAG | 902 |
| NM_005080_1793-1811 | UACCCAUGCAAUUAAAAGG | 903 | CCUUUUAAUUGCAUGGGUA | 904 |
| NM_005080_1795-1813 | CCCAUGCAAUUAAAAGGUA | 905 | UACCUUUUAAUUGCAUGGG | 906 |
| NM_005080_1798-1816 | AUGCAAUUAAAAGGUACAA | 907 | UUGUACCUUUUAAUUGCAU | 908 |
| NM_005080_1799-1817 | UGCAAUUAAAAGGUACAAU | 909 | AUUGUACCUUUUAAUUGCA | 910 |
| NM_005080_1800-1818 | GCAAUUAAAAGGUACAAUG | 911 | CAUUGUACCUUUUAAUUGC | 912 |
| NM_005080_1801-1819 | CAAUUAAAAGGUACAAUGC | 913 | GCAUUGUACCUUUUAAUUG | 914 |
| NM_005080_146-164 | GCCAGGCCCUGCCGCUCAU | 915 | AUGAGCGGCAGGGCCUGGC | 916 |
| NM_005080_147-165 | CCAGGCCCUGCCGCUCAUG | 917 | CAUGAGCGGCAGGGCCUGG | 918 |
| NM_005080_148-166 | CAGGCCCUGCCGCUCAUGG | 919 | CCAUGAGCGGCAGGGCCUG | 920 |
| NM_005080_149-167 | AGGCCCUGCCGCUCAUGGU | 921 | ACCAUGAGCGGCAGGGCCU | 922 |
| NM_005080_155-173 | UGCCGCUCAUGGUGCCAGC | 923 | GCUGGCACCAUGAGCGGCA | 924 |
| NM_005080_157-175 | CCGCUCAUGGUGCCAGCCC | 925 | GGGCUGGCACCAUGAGCGG | 926 |
| NM_005080_158-176 | CGCUCAUGGUGCCAGCCCA | 927 | UGGGCUGGCACCAUGAGCG | 928 |
| NM_005080_159-177 | GCUCAUGGUGCCAGCCCAG | 929 | CUGGGCUGGCACCAUGAGC | 930 |
| NM_005080_188-206 | GCCCGGAGGCAGCGAGCGG | 931 | CCGCUCGCUGCCUCCGGGC | 932 |
| NM_005080_189-207 | CCCGGAGGCAGCGAGCGGG | 933 | CCCGCUCGCUGCCUCCGGG | 934 |
| NM_005080_195-213 | GGCAGCGAGCGGGGGCUG | 935 | CAGCCCCCGCUCGCUGCC | 936 |
| NM_005080_196-214 | GCAGCGAGCGGGGGCUGC | 937 | GCAGCCCCCGCUCGCUGC | 938 |
| NM_005080_197-215 | CAGCGAGCGGGGGCUGCC | 939 | GGCAGCCCCCGCUCGCUG | 940 |
| NM_005080_198-216 | AGCGAGCGGGGGCUGCCC | 941 | GGGCAGCCCCCGCUCGCU | 942 |
| NM_005080_205-223 | GGGGGCUGCCCCAGGCGC | 943 | GCGCCUGGGGCAGCCCCC | 944 |
| NM_005080_206-224 | GGGGCUGCCCCAGGCGCG | 945 | CGCGCCUGGGGCAGCCCCC | 946 |
| NM_005080_207-225 | GGGGCUGCCCCAGGCGCGC | 947 | GCGCGCCUGGGGCAGCCCC | 948 |
| NM_005080_211-229 | CUGCCCCAGGCGCGCAAGC | 949 | GCUUGCGCGCCUGGGGCAG | 950 |
| NM_005080_250-268 | AGCCCCGAGGAGAAGGCGC | 951 | GCGCCUUCUCCUCGGGGCU | 952 |

TABLE 8-continued

XBP-1 human/Rhesus siRNAs

| Oligo Name/<br>Positions on target<br>sequence (5' to 3') | sense (5'-3') | SEQ<br>ID<br>NO: | antisense (5'-3') | SEQ<br>ID<br>NO: |
|---|---|---|---|---|
| NM_005080_256-274 | GAGGAGAAGGCGCUGAGGA | 953 | UCCUCAGCGCCUUCUCCUC | 954 |
| NM_005080_263-281 | AGGCGCUGAGGAGGAAACU | 955 | AGUUUCCUCCUCAGCGCCU | 956 |
| NM_005080_264-282 | GGCGCUGAGGAGGAAACUG | 957 | CAGUUUCCUCCUCAGCGCC | 958 |
| NM_005080_285-303 | AAACAGAGUAGCAGCUCAG | 959 | CUGAGCUGCUACUCUGUUU | 960 |
| NM_005080_286-304 | AACAGAGUAGCAGCUCAGA | 961 | UCUGAGCUGCUACUCUGUU | 962 |
| NM_005080_287-305 | ACAGAGUAGCAGCUCAGAC | 963 | GUCUGAGCUGCUACUCUGU | 964 |
| NM_005080_294-312 | AGCAGCUCAGACUGCCAGA | 965 | UCUGGCAGUCUGAGCUGCU | 966 |
| NM_005080_295-313 | GCAGCUCAGACUGCCAGAG | 967 | CUCUGGCAGUCUGAGCUGC | 968 |
| NM_005080_296-314 | CAGCUCAGACUGCCAGAGA | 969 | UCUCUGGCAGUCUGAGCUG | 970 |
| NM_005080_298-316 | GCUCAGACUGCCAGAGAUC | 971 | GAUCUCUGGCAGUCUGAGC | 972 |
| NM_005080_303-321 | GACUGCCAGAGAUCGAAAG | 973 | CUUUCGAUCUCUGGCAGUC | 974 |
| NM_005080_332-350 | UGAGUGAGCUGGAACAGCA | 975 | UGCUGUUCCAGCUCACUCA | 976 |
| NM_005080_339-357 | GCUGGAACAGCAAGUGGUA | 977 | UACCACUUGCUGUUCCAGC | 978 |
| NM_005080_340-358 | CUGGAACAGCAAGUGGUAG | 979 | CUACCACUUGCUGUUCCAG | 980 |
| NM_005080_345-363 | ACAGCAAGUGGUAGAUUUA | 981 | UAAAUCUACCACUUGCUGU | 982 |
| NM_005080_346-364 | CAGCAAGUGGUAGAUUUAG | 983 | CUAAAUCUACCACUUGCUG | 984 |
| NM_005080_348-366 | GCAAGUGGUAGAUUUAGAA | 985 | UUCUAAAUCUACCACUUGC | 986 |
| NM_005080_349-367 | CAAGUGGUAGAUUUAGAAG | 987 | CUUCUAAAUCUACCACUUG | 988 |
| NM_005080_352-370 | GUGGUAGAUUUAGAAGAAG | 989 | CUUCUUCUAAAUCUACCAC | 990 |
| NM_005080_353-371 | UGGUAGAUUUAGAAGAAGA | 991 | UCUUCUUCUAAAUCUACCA | 992 |
| NM_005080_354-372 | GGUAGAUUUAGAAGAAGAG | 993 | CUCUUCUUCUAAAUCUACC | 994 |
| NM_005080_355-373 | GUAGAUUUAGAAGAAGAGA | 995 | UCUCUUCUUCUAAAUCUAC | 996 |
| NM_005080_361-379 | UUAGAAGAAGAGAACCAAA | 997 | UUUGGUUCUCUUCUUCUAA | 998 |
| NM_005080_366-384 | AGAAGAGAACCAAAAACUU | 999 | AAGUUUUUGGUUCUCUUCU | 1000 |
| NM_005080_369-387 | AGAGAACCAAAAACUUUUG | 1001 | CAAAAGUUUUUGGUUCUCU | 1002 |
| NM_005080_370-388 | GAGAACCAAAAACUUUUGC | 1003 | GCAAAAGUUUUUGGUUCUC | 1004 |
| NM_005080_372-390 | GAACCAAAAACUUUUGCUA | 1005 | UAGCAAAAGUUUUUGGUUC | 1006 |
| NM_005080_376-394 | CAAAAACUUUUGCUAGAAA | 1007 | UUUCUAGCAAAAGUUUUUG | 1008 |
| NM_005080_381-399 | ACUUUUGCUAGAAAAUCAG | 1009 | CUGAUUUUCUAGCAAAAGU | 1010 |
| NM_005080_384-402 | UUUGCUAGAAAAUCAGCUU | 1011 | AAGCUGAUUUUCUAGCAAA | 1012 |
| NM_005080_388-406 | CUAGAAAAUCAGCUUUUAC | 1013 | GUAAAAGCUGAUUUUCUAG | 1014 |
| NM_005080_392-410 | AAAAUCAGCUUUUACGAGA | 1015 | UCUCGUAAAAGCUGAUUUU | 1016 |
| NM_005080_394-412 | AAUCAGCUUUUACGAGAGA | 1017 | UCUCUCGUAAAAGCUGAUU | 1018 |
| NM_005080_396-414 | UCAGCUUUUACGAGAGAAA | 1019 | UUUCUCUCGUAAAAGCUGA | 1020 |
| NM_005080_400-418 | CUUUUACGAGAGAAAACUC | 1021 | GAGUUUUCUCUCGUAAAAG | 1022 |
| NM_005080_421-439 | GGCCUUGUAGUUGAGAACC | 1023 | GGUUCUCAACUACAAGGCC | 1024 |
| NM_005080_422-440 | GCCUUGUAGUUGAGAACCA | 1025 | UGGUUCUCAACUACAAGGC | 1026 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_423-441 | CCUUGUAGUUGAGAACCAG | 1027 | CUGGUUCUCAACUACAAGG | 1028 |
| NM_005080_425-443 | UUGUAGUUGAGAACCAGGA | 1029 | UCCUGGUUCUCAACUACAA | 1030 |
| NM_005080_428-446 | UAGUUGAGAACCAGGAGUU | 1031 | AACUCCUGGUUCUCAACUA | 1032 |
| NM_005080_429-447 | AGUUGAGAACCAGGAGUUA | 1033 | UAACUCCUGGUUCUCAACU | 1034 |
| NM_005080_432-450 | UGAGAACCAGGAGUUAAGA | 1035 | UCUUAACUCCUGGUUCUCA | 1036 |
| NM_005080_433-451 | GAGAACCAGGAGUUAAGAC | 1037 | GUCUUAACUCCUGGUUCUC | 1038 |
| NM_005080_434-452 | AGAACCAGGAGUUAAGACA | 1039 | UGUCUUAACUCCUGGUUCU | 1040 |
| NM_005080_435-453 | GAACCAGGAGUUAAGACAG | 1041 | CUGUCUUAACUCCUGGUUC | 1042 |
| NM_005080_436-454 | AACCAGGAGUUAAGACAGC | 1043 | GCUGUCUUAACUCCUGGUU | 1044 |
| NM_005080_459-477 | GGGGAUGGAUGCCCUGGUU | 1045 | AACCAGGGCAUCCAUCCCC | 1046 |
| NM_005080_460-478 | GGGAUGGAUGCCCUGGUUG | 1047 | CAACCAGGGCAUCCAUCCC | 1048 |
| NM_005080_462-480 | GAUGGAUGCCCUGGUUGCU | 1049 | AGCAACCAGGGCAUCCAUC | 1050 |
| NM_005080_486-504 | GGAGGCGGAAGCCAAGGGG | 1051 | CCCCTTGGCTTCCGCCTCC | 1052 |
| NM_005080_510-528 | AGUGAGGCCAGUGGCCGGG | 1053 | CCCGGCCACUGGCCUCACU | 1054 |
| NM_005080_513-531 | GAGGCCAGUGGCCGGGUCU | 1055 | AGACCCGGCCACUGGCCUC | 1056 |
| NM_005080_514-532 | AGGCCAGUGGCCGGGUCUG | 1057 | CAGACCCGGCCACUGGCCU | 1058 |
| NM_005080_515-533 | GGCCAGUGGCCGGGUCUGC | 1059 | GCAGACCCGGCCACUGGCC | 1060 |
| NM_005080_516-534 | GCCAGUGGCCGGGUCUGCU | 1061 | AGCAGACCCGGCCACUGGC | 1062 |
| NM_005080_520-538 | GUGGCCGGGUCUGCUGAGU | 1063 | ACUCAGCAGACCCGGCCAC | 1064 |
| NM_005080_521-539 | UGGCCGGGUCUGCUGAGUC | 1065 | GACUCAGCAGACCCGGCCA | 1066 |
| NM_005080_523-541 | GCCGGGUCUGCUGAGUCCG | 1067 | CGGACUCAGCAGACCCGGC | 1068 |
| NM_005080_578-596 | AGGCCCAGUUGUCACCCCU | 1069 | AGGGGUGACAACUGGGCCU | 1070 |
| NM_005080_581-599 | CCCAGUUGUCACCCCUCCA | 1071 | UGGAGGGGUGACAACUGGG | 1072 |
| NM_005080_582-600 | CCAGUUGUCACCCCUCCAG | 1073 | CUGGAGGGGUGACAACUGG | 1074 |
| NM_005080_583-601 | CAGUUGUCACCCCUCCAGA | 1075 | UCUGGAGGGGUGACAACUG | 1076 |
| NM_005080_584-602 | AGUUGUCACCCCUCCAGAA | 1077 | UUCUGGAGGGGUGACAACU | 1078 |
| NM_005080_585-603 | GUUGUCACCCCUCCAGAAC | 1079 | GUUCUGGAGGGGUGACAAC | 1080 |
| NM_005080_586-604 | UUGUCACCCCUCCAGAACA | 1081 | UGUUCUGGAGGGGUGACAA | 1082 |
| NM_005080_587-605 | UGUCACCCCUCCAGAACAU | 1083 | AUGUUCUGGAGGGGUGACA | 1084 |
| NM_005080_588-606 | GUCACCCCUCCAGAACAUC | 1085 | GAUGUUCUGGAGGGGUGAC | 1086 |
| NM_005080_589-607 | UCACCCCUCCAGAACAUCU | 1087 | AGAUGUUCUGGAGGGGUGA | 1088 |
| NM_005080_590-608 | CACCCCUCCAGAACAUCUC | 1089 | GAGAUGUUCUGGAGGGGUG | 1090 |
| NM_005080_591-609 | ACCCCUCCAGAACAUCUCC | 1091 | GGAGAUGUUCUGGAGGGGU | 1092 |
| NM_005080_597-615 | CCAGAACAUCUCCCCAUGG | 1093 | CCAUGGGGAGAUGUUCUGG | 1094 |
| NM_005080_600-618 | GAACAUCUCCCCAUGGAUU | 1095 | AAUCCAUGGGGAGAUGUUC | 1096 |
| NM_005080_603-621 | CAUCUCCCCAUGGAUUCUG | 1097 | CAGAAUCCAUGGGGAGAUG | 1098 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_619-637 | CUGGCGGUAUUGACUCUUC | 1099 | GAAGAGUCAAUACCGCCAG | 1100 |
| NM_005080_620-638 | UGGCGGUAUUGACUCUUCA | 1101 | UGAAGAGUCAAUACCGCCA | 1102 |
| NM_005080_622-640 | GCGGUAUUGACUCUUCAGA | 1103 | UCUGAAGAGUCAAUACCGC | 1104 |
| NM_005080_623-641 | CGGUAUUGACUCUUCAGAU | 1105 | AUCUGAAGAGUCAAUACCG | 1106 |
| NM_005080_624-642 | GGUAUUGACUCUUCAGAUU | 1107 | AAUCUGAAGAGUCAAUACC | 1108 |
| NM_005080_625-643 | GUAUUGACUCUUCAGAUUC | 1109 | GAAUCUGAAGAGUCAAUAC | 1110 |
| NM_005080_626-644 | UAUUGACUCUUCAGAUUCA | 1111 | UGAAUCUGAAGAGUCAAUA | 1112 |
| NM_005080_629-647 | UGACUCUUCAGAUUCAGAG | 1113 | CUCUGAAUCUGAAGAGUCA | 1114 |
| NM_005080_632-650 | CUCUUCAGAUUCAGAGUCU | 1115 | AGACUCUGAAUCUGAAGAG | 1116 |
| NM_005080_634-652 | CUUCAGAUUCAGAGUCUGA | 1117 | UCAGACUCUGAAUCUGAAG | 1118 |
| NM_005080_637-655 | CAGAUUCAGAGUCUGAUAU | 1119 | AUAUCAGACUCUGAAUCUG | 1120 |
| NM_005080_638-656 | AGAUUCAGAGUCUGAUAUC | 1121 | GAUAUCAGACUCUGAAUCU | 1122 |
| NM_005080_639-657 | GAUUCAGAGUCUGAUAUCC | 1123 | GGAUAUCAGACUCUGAAUC | 1124 |
| NM_005080_642-660 | UCAGAGUCUGAUAUCCUGU | 1125 | ACAGGAUAUCAGACUCUGA | 1126 |
| NM_005080_643-661 | CAGAGUCUGAUAUCCUGUU | 1127 | AACAGGAUAUCAGACUCUG | 1128 |
| NM_005080_644-662 | AGAGUCUGAUAUCCUGUUG | 1129 | CAACAGGAUAUCAGACUCU | 1130 |
| NM_005080_646-664 | AGUCUGAUAUCCUGUUGGG | 1131 | CCCAACAGGAUAUCAGACU | 1132 |
| NM_005080_649-667 | CUGAUAUCCUGUUGGGCAU | 1133 | AUGCCCAACAGGAUAUCAG | 1134 |
| NM_005080_650-668 | UGAUAUCCUGUUGGGCAUU | 1135 | AAUGCCCAACAGGAUAUCA | 1136 |
| NM_005080_653-671 | UAUCCUGUUGGGCAUUCUG | 1137 | CAGAAUGCCCAACAGGAUA | 1138 |
| NM_005080_658-676 | UGUUGGGCAUUCUGGACAA | 1139 | UUGUCCAGAAUGCCCAACA | 1140 |
| NM_005080_659-677 | GUUGGGCAUUCUGGACAAC | 1141 | GUUGUCCAGAAUGCCCAAC | 1142 |
| NM_005080_660-678 | UUGGGCAUUCUGGACAACU | 1143 | AGUUGUCCAGAAUGCCCAA | 1144 |
| NM_005080_663-681 | GGCAUUCUGGACAACUUGG | 1145 | CCAAGUUGUCCAGAAUGCC | 1146 |
| NM_005080_664-682 | GCAUUCUGGACAACUUGGA | 1147 | UCCAAGUUGUCCAGAAUGC | 1148 |
| NM_005080_668-686 | UCUGGACAACUUGGACCCA | 1149 | UGGGUCCAAGUUGUCCAGA | 1150 |
| NM_005080_671-689 | GGACAACUUGGACCCAGUC | 1151 | GACUGGGUCCAAGUUGUCC | 1152 |
| NM_005080_676-694 | ACUUGGACCCAGUCAUGUU | 1153 | AACAUGACUGGGUCCAAGU | 1154 |
| NM_005080_677-695 | CUUGGACCCAGUCAUGUUC | 1155 | GAACAUGACUGGGUCCAAG | 1156 |
| NM_005080_679-697 | UGGACCCAGUCAUGUUCUU | 1157 | AAGAACAUGACUGGGUCCA | 1158 |
| NM_005080_680-698 | GGACCCAGUCAUGUUCUUC | 1159 | GAAGAACAUGACUGGGUCC | 1160 |
| NM_005080_682-700 | ACCCAGUCAUGUUCUUCAA | 1161 | UUGAAGAACAUGACUGGGU | 1162 |
| NM_005080_687-705 | GUCAUGUUCUUCAAAUGCC | 1163 | GGCAUUUGAAGAACAUGAC | 1164 |
| NM_005080_689-707 | CAUGUUCUUCAAAUGCCCU | 1165 | AGGGCAUUUGAAGAACAUG | 1166 |
| NM_005080_695-713 | CUUCAAAUGCCCUUCCCCA | 1167 | UGGGGAAGGGCAUUUGAAG | 1168 |
| NM_005080_696-714 | UUCAAAUGCCCUUCCCCAG | 1169 | CUGGGGAAGGGCAUUUGAA | 1170 |
| NM_005080_698-716 | CAAAUGCCCUUCCCCAGAG | 1171 | CUCUGGGGAAGGGCAUUUG | 1172 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_731-749 | GGAGCUCCCAGAGGUCUAC | 1173 | GUAGACCUCUGGGAGCUCC | 1174 |
| NM_005080_732-750 | GAGCUCCCAGAGGUCUACC | 1175 | GGUAGACCUCUGGGAGCUC | 1176 |
| NM_005080_733-751 | AGCUCCCAGAGGUCUACCC | 1177 | GGGUAGACCUCUGGGAGCU | 1178 |
| NM_005080_736-754 | UCCCAGAGGUCUACCCAGA | 1179 | UCUGGGUAGACCUCUGGGA | 1180 |
| NM_005080_737-755 | CCCAGAGGUCUACCCAGAA | 1181 | UUCUGGGUAGACCUCUGGG | 1182 |
| NM_005080_738-756 | CCAGAGGUCUACCCAGAAG | 1183 | CUUCUGGGUAGACCUCUGG | 1184 |
| NM_005080_740-758 | AGAGGUCUACCCAGAAGGA | 1185 | UCCUUCUGGGUAGACCUCU | 1186 |
| NM_005080_741-759 | GAGGUCUACCCAGAAGGAC | 1187 | GUCCUUCUGGGUAGACCUC | 1188 |
| NM_005080_742-760 | AGGUCUACCCAGAAGGACC | 1189 | GGUCCUUCUGGGUAGACCU | 1190 |
| NM_005080_743-761 | GGUCUACCCAGAAGGACCC | 1191 | GGGUCCUUCUGGGUAGACC | 1192 |
| NM_005080_748-766 | ACCCAGAAGGACCCAGUUC | 1193 | GAACUGGGUCCUUCUGGGU | 1194 |
| NM_005080_749-767 | CCCAGAAGGACCCAGUUCC | 1195 | GGAACUGGGUCCUUCUGGG | 1196 |
| NM_005080_750-768 | CCAGAAGGACCCAGUUCCU | 1197 | AGGAACUGGGUCCUUCUGG | 1198 |
| NM_005080_751-769 | CAGAAGGACCCAGUUCCUU | 1199 | AAGGAACUGGGUCCUUCUG | 1200 |
| NM_005080_752-770 | AGAAGGACCCAGUUCCUUA | 1201 | UAAGGAACUGGGUCCUUCU | 1202 |
| NM_005080_756-774 | GGACCCAGUUCCUUACCAG | 1203 | CUGGUAAGGAACUGGGUCC | 1204 |
| NM_005080_758-776 | ACCCAGUUCCUUACCAGCC | 1205 | GGCUGGUAAGGAACUGGGU | 1206 |
| NM_005080_759-777 | CCCAGUUCCUUACCAGCCU | 1207 | AGGCUGGUAAGGAACUGGG | 1208 |
| NM_005080_760-778 | CCAGUUCCUUACCAGCCUC | 1209 | GAGGCUGGUAAGGAACUGG | 1210 |
| NM_005080_761-779 | CAGUUCCUUACCAGCCUCC | 1211 | GGAGGCUGGUAAGGAACUG | 1212 |
| NM_005080_762-780 | AGUUCCUUACCAGCCUCCC | 1213 | GGGAGGCUGGUAAGGAACU | 1214 |
| NM_005080_767-785 | CUUACCAGCCUCCCUUUCU | 1215 | AGAAAGGGAGGCUGGUAAG | 1216 |
| NM_005080_769-787 | UACCAGCCUCCCUUUCUCU | 1217 | AGAGAAAGGGAGGCUGGUA | 1218 |
| NM_005080_773-791 | AGCCUCCCUUUCUCUGUCA | 1219 | UGACAGAGAAAGGGAGGCU | 1220 |
| NM_005080_779-797 | CCUUUCUCUGUCAGUGGGG | 1221 | CCCCACUGACAGAGAAAGG | 1222 |
| NM_005080_786-804 | CUGUCAGUGGGGACGUCAU | 1223 | AUGACGUCCCCACUGACAG | 1224 |
| NM_005080_787-805 | UGUCAGUGGGGACGUCAUC | 1225 | GAUGACGUCCCCACUGACA | 1226 |
| NM_005080_789-807 | UCAGUGGGGACGUCAUCAG | 1227 | CUGAUGACGUCCCCACUGA | 1228 |
| NM_005080_793-811 | UGGGGACGUCAUCAGCCAA | 1229 | UUGGCUGAUGACGUCCCCA | 1230 |
| NM_005080_795-813 | GGGACGUCAUCAGCCAAGC | 1231 | GCUUGGCUGAUGACGUCCC | 1232 |
| NM_005080_797-815 | GACGUCAUCAGCCAAGCUG | 1233 | CAGCUUGGCUGAUGACGUC | 1234 |
| NM_005080_798-816 | ACGUCAUCAGCCAAGCUGG | 1235 | CCAGCUUGGCUGAUGACGU | 1236 |
| NM_005080_800-818 | GUCAUCAGCCAAGCUGGAA | 1237 | UUCCAGCUUGGCUGAUGAC | 1238 |
| NM_005080_804-822 | UCAGCCAAGCUGGAAGCCA | 1239 | UGGCUUCCAGCUUGGCUGA | 1240 |
| NM_005080_806-824 | AGCCAAGCUGGAAGCCAUU | 1241 | AAUGGCUUCCAGCUUGGCU | 1242 |
| NM_005080_807-825 | GCCAAGCUGGAAGCCAUUA | 1243 | UAAUGGCUUCCAGCUUGGC | 1244 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_808-826 | CCAAGCUGGAAGCCAUUAA | 1245 | UUAAUGGCUUCCAGCUUGG | 1246 |
| NM_005080_809-827 | CAAGCUGGAAGCCAUUAAU | 1247 | AUUAAUGGCUUCCAGCUUG | 1248 |
| NM_005080_810-828 | AAGCUGGAAGCCAUUAAUG | 1249 | CAUUAAUGGCUUCCAGCUU | 1250 |
| NM_005080_811-829 | AGCUGGAAGCCAUUAAUGA | 1251 | UCAUUAAUGGCUUCCAGCU | 1252 |
| NM_005080_813-831 | CUGGAAGCCAUUAAUGAAC | 1253 | GUUCAUUAAUGGCUUCCAG | 1254 |
| NM_005080_814-832 | UGGAAGCCAUUAAUGAACU | 1255 | AGUUCAUUAAUGGCUUCCA | 1256 |
| NM_005080_818-836 | AGCCAUUAAUGAACUAAUU | 1257 | AAUUAGUUCAUUAAUGGCU | 1258 |
| NM_005080_820-838 | CCAUUAAUGAACUAAUUCG | 1259 | CGAAUUAGUUCAUUAAUGG | 1260 |
| NM_005080_837-855 | CGUUUUGACCACAUAUAUA | 1261 | UAUAUAUGUGGUCAAAACG | 1262 |
| NM_005080_844-862 | ACCACAUAUAUACCAAGCC | 1263 | GGCUUGGUAUAUAUGUGGU | 1264 |
| NM_005080_872-890 | AGAGAUACCCUCUGAGACA | 1265 | UGUCUCAGAGGGUAUCUCU | 1266 |
| NM_005080_873-891 | GAGAUACCCUCUGAGACAG | 1267 | CUGUCUCAGAGGGUAUCUC | 1268 |
| NM_005080_874-892 | AGAUACCCUCUGAGACAGA | 1269 | UCUGUCUCAGAGGGUAUCU | 1270 |
| NM_005080_876-894 | AUACCCUCUGAGACAGAGA | 1271 | UCUCUGUCUCAGAGGGUAU | 1272 |
| NM_005080_889-907 | CAGAGAGCCAAGCUAAUGU | 1273 | ACAUUAGCUUGGCUCUCUG | 1274 |
| NM_005080_890-908 | AGAGAGCCAAGCUAAUGUG | 1275 | CACAUUAGCUUGGCUCUCU | 1276 |
| NM_005080_897-915 | CAAGCUAAUGUGGUAGUGA | 1277 | UCACUACCACAUUAGCUUG | 1278 |
| NM_005080_898-916 | AAGCUAAUGUGGUAGUGAA | 1279 | UUCACUACCACAUUAGCUU | 1280 |
| NM_005080_901-919 | CUAAUGUGGUAGUGAAAAU | 1281 | AUUUUCACUACCACAUUAG | 1282 |
| NM_005080_903-921 | AAUGUGGUAGUGAAAAUCG | 1283 | CGAUUUUCACUACCACAUU | 1284 |
| NM_005080_904-922 | AUGUGGUAGUGAAAAUCGA | 1285 | UCGAUUUUCACUACCACAU | 1286 |
| NM_005080_906-924 | GUGGUAGUGAAAAUCGAGG | 1287 | CCUCGAUUUUCACUACCAC | 1288 |
| NM_005080_907-925 | UGGUAGUGAAAAUCGAGGA | 1289 | UCCUCGAUUUUCACUACCA | 1290 |
| NM_005080_910-928 | UAGUGAAAAUCGAGGAAGC | 1291 | GCUUCCUCGAUUUUCACUA | 1292 |
| NM_005080_913-931 | UGAAAAUCGAGGAAGCACC | 1293 | GGUGCUUCCUCGAUUUUCA | 1294 |
| NM_005080_916-934 | AAAUCGAGGAAGCACCUCU | 1295 | AGAGGUGCUUCCUCGAUUU | 1296 |
| NM_005080_918-936 | AUCGAGGAAGCACCUCUCA | 1297 | UGAGAGGUGCUUCCUCGAU | 1298 |
| NM_005080_919-937 | UCGAGGAAGCACCUCUCAG | 1299 | CUGAGAGGUGCUUCCUCGA | 1300 |
| NM_005080_920-938 | CGAGGAAGCACCUCUCAGC | 1301 | GCUGAGAGGUGCUUCCUCG | 1302 |
| NM_005080_922-940 | AGGAAGCACCUCUCAGCCC | 1303 | GGGCUGAGAGGUGCUUCCU | 1304 |
| NM_005080_923-941 | GGAAGCACCUCUCAGCCCC | 1305 | GGGGCUGAGAGGUGCUUCC | 1306 |
| NM_005080_929-947 | ACCUCUCAGCCCCUCAGAG | 1307 | CUCUGAGGGGCUGAGAGGU | 1308 |
| NM_005080_930-948 | CCUCUCAGCCCCUCAGAGA | 1309 | UCUCUGAGGGGCUGAGAGG | 1310 |
| NM_005080_931-949 | CUCUCAGCCCCUCAGAGAA | 1311 | UUCUCUGAGGGGCUGAGAG | 1312 |
| NM_005080_932-950 | UCUCAGCCCCUCAGAGAAU | 1313 | AUUCUCUGAGGGGCUGAGA | 1314 |
| NM_005080_933-951 | CUCAGCCCCUCAGAGAAUG | 1315 | CAUUCUCUGAGGGGCUGAG | 1316 |
| NM_005080_934-952 | UCAGCCCCUCAGAGAAUGA | 1317 | UCAUUCUCUGAGGGGCUGA | 1318 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_935-953 | CAGCCCCUCAGAGAAUGAU | 1319 | AUCAUUCUCUGAGGGGCUG | 1320 |
| NM_005080_936-954 | AGCCCCUCAGAGAAUGAUC | 1321 | GAUCAUUCUCUGAGGGGCU | 1322 |
| NM_005080_938-956 | CCCCUCAGAGAAUGAUCAC | 1323 | GUGAUCAUUCUCUGAGGGG | 1324 |
| NM_005080_941-959 | CUCAGAGAAUGAUCACCCU | 1325 | AGGGUGAUCAUUCUCUGAG | 1326 |
| NM_005080_942-960 | UCAGAGAAUGAUCACCCUG | 1327 | CAGGGUGAUCAUUCUCUGA | 1328 |
| NM_005080_943-961 | CAGAGAAUGAUCACCCUGA | 1329 | UCAGGGUGAUCAUUCUCUG | 1330 |
| NM_005080_944-962 | AGAGAAUGAUCACCCUGAA | 1331 | UUCAGGGUGAUCAUUCUCU | 1332 |
| NM_005080_946-964 | AGAAUGAUCACCCUGAAUU | 1333 | AAUUCAGGGUGAUCAUUCU | 1334 |
| NM_005080_947-965 | GAAUGAUCACCCUGAAUUC | 1335 | GAAUUCAGGGUGAUCAUUC | 1336 |
| NM_005080_948-966 | AAUGAUCACCCUGAAUUCA | 1337 | UGAAUUCAGGGUGAUCAUU | 1338 |
| NM_005080_949-967 | AUGAUCACCCUGAAUUCAU | 1339 | AUGAAUUCAGGGUGAUCAU | 1340 |
| NM_005080_955-973 | ACCCUGAAUUCAUUGUCUC | 1341 | GAGACAAUGAAUUCAGGGU | 1342 |
| NM_005080_956-974 | CCCUGAAUUCAUUGUCUCA | 1343 | UGAGACAAUGAAUUCAGGG | 1344 |
| NM_005080_957-975 | CCUGAAUUCAUUGUCUCAG | 1345 | CUGAGACAAUGAAUUCAGG | 1346 |
| NM_005080_960-978 | GAAUUCAUUGUCUCAGUGA | 1347 | UCACUGAGACAAUGAAUUC | 1348 |
| NM_005080_961-979 | AAUUCAUUGUCUCAGUGAA | 1349 | UUCACUGAGACAAUGAAUU | 1350 |
| NM_005080_965-983 | CAUUGUCUCAGUGAAGGAA | 1351 | UUCCUUCACUGAGACAAUG | 1352 |
| NM_005080_967-985 | UUGUCUCAGUGAAGGAAGA | 1353 | UCUUCCUUCACUGAGACAA | 1354 |
| NM_005080_968-986 | UGUCUCAGUGAAGGAAGAA | 1355 | UUCUUCCUUCACUGAGACA | 1356 |
| NM_005080_971-989 | CUCAGUGAAGGAAGAACCU | 1357 | AGGUUCUUCCUUCACUGAG | 1358 |
| NM_005080_972-990 | UCAGUGAAGGAAGAACCUG | 1359 | CAGGUUCUUCCUUCACUGA | 1360 |
| NM_005080_973-991 | CAGUGAAGGAAGAACCUGU | 1361 | ACAGGUUCUUCCUUCACUG | 1362 |
| NM_005080_980-998 | GGAAGAACCUGUAGAAGAU | 1363 | AUCUUCUACAGGUUCUUCC | 1364 |
| NM_005080_984-1002 | GAACCUGUAGAAGAUGACC | 1365 | GGUCAUCUUCUACAGGUUC | 1366 |
| NM_005080_986-1004 | ACCUGUAGAAGAUGACCUC | 1367 | GAGGUCAUCUUCUACAGGU | 1368 |
| NM_005080_1023-1041 | UCAAAUCUGCUUUCAUCCA | 1369 | UGGAUGAAAGCAGAUUUGA | 1370 |
| NM_005080_1151-1169 | UUCUUGGGAGGACACUUUU | 1371 | AAAAGUGUCCUCCCAAGAA | 1372 |
| NM_005080_1367-1385 | UCUUUUGACAUCCAGCAGU | 1373 | ACUGCUGGAUGUCAAAAGA | 1374 |
| NM_005080_1414-1432 | UAAGAAAUAUUACUAUAAU | 1375 | AUUAUAGUAAUAUUUCUUA | 1376 |
| NM_005080_1415-1433 | AAGAAAUAUUACUAUAAUU | 1377 | AAUUAUAGUAAUAUUUCUU | 1378 |
| NM_005080_1674-1692 | ACUUCAAGUAAGAUCAAGA | 1379 | UCUUGAUCUUACUUGAAGU | 1380 |
| NM_005080_1675-1693 | CUUCAAGUAAGAUCAAGAA | 1381 | UUCUUGAUCUUACUUGAAG | 1382 |
| NM_005080_330-348 | AAUGAGUGAGCUGGAACAG | 1383 | CUGUUCCAGCUCACUCAUU | 1384 |
| NM_005080_333-351 | GAGUGAGCUGGAACAGCAA | 1385 | UUGCUGUUCCAGCUCACUC | 1386 |
| NM_005080_592-610 | CCCCUCCAGAACAUCUCCC | 1387 | GGGAGAUGUUCUGGAGGGG | 1388 |
| NM_005080_665-683 | CAUUCUGGACAACUUGGAC | 1389 | GUCCAAGUUGUCCAGAAUG | 1390 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_815-833 | GGAAGCCAUUAAUGAACUA | 1391 | UAGUUCAUUAAUGGCUUCC | 1392 |
| NM_005080_1029-1047 | CUGCUUUCAUCCAGCCACU | 1393 | AGUGGCUGGAUGAAAGCAG | 1394 |
| NM_005080_1077-1095 | GCUUACAGUGACUGUGGAU | 1395 | AUCCACAGUCACUGUAAGC | 1396 |
| NM_005080_1222-1240 | GUUGCCCUUUUCCUUGACU | 1397 | AGUCAAGGAAAAGGGCAAC | 1398 |
| NM_005080_1285-1303 | UUCAAAAAGCCAAAAUAGA | 1399 | UCUAUUUUGGCUUUUUGAA | 1400 |
| NM_005080_1334-1352 | UGUUCAGAUCUCAUAGAUG | 1401 | CAUCUAUGAGAUCUGAACA | 1402 |
| NM_005080_1335-1353 | GUUCAGAUCUCAUAGAUGA | 1403 | UCAUCUAUGAGAUCUGAAC | 1404 |
| NM_005080_1436-1454 | GAACUACAGCUUUUAAGAU | 1405 | AUCUUAAAAGCUGUAGUUC | 1406 |
| NM_005080_1449-1467 | UAAGAUUGUACUUUUAUCU | 1407 | AGAUAAAAGUACAAUCUUA | 1408 |
| NM_005080_1450-1468 | AAGAUUGUACUUUUAUCUU | 1409 | AAGAUAAAAGUACAAUCUU | 1410 |
| NM_005080_114-132 | GCAGCCCGCCUCCGCCGCC | 1411 | GGCGGCGGAGGCGGGCUGC | 1412 |
| NM_005080_1555-1573 | UUCUUUAUCAUUUCUCUUC | 1413 | GAAGAGAAAUGAUAAAGAA | 1414 |
| NM_005080_1556-1574 | UCUUUAUCAUUUCUCUCC | 1415 | GGAAGAGAAAUGAUAAAGA | 1416 |
| NM_005080_1561-1579 | AUCAUUUCUCUUCCCCCUU | 1417 | AAGGGGGAAGAGAAAUGAU | 1418 |
| NM_005080_1562-1580 | UCAUUUCUCUUCCCCCUUU | 1419 | AAAGGGGAAGAGAAAUGA | 1420 |
| NM_005080_1569-1587 | UCUUCCCCCUUUUUGGCAU | 1421 | AUGCCAAAAGGGGGAAGA | 1422 |
| NM_005080_1588-1606 | CCUGGCUUGCCUCCAGUUU | 1423 | AAACUGGAGGCAAGCCAGG | 1424 |
| NM_005080_1640-1658 | AACACCUGCUGAGGGGCU | 1425 | AGCCCCCUCAGCAGGUGUU | 1426 |
| NM_005080_1641-1659 | ACACCUGCUGAGGGGCUC | 1427 | GAGCCCCUCAGCAGGUGU | 1428 |
| NM_005080_1642-1660 | CACCUGCUGAGGGGCUCU | 1429 | AGAGCCCCUCAGCAGGUG | 1430 |
| NM_005080_1650-1668 | GAGGGGGCUCUUUCCCUCA | 1431 | UGAGGGAAAGAGCCCCCUC | 1432 |
| NM_005080_1686-1704 | AUCAAGAAUCUUUUGUGAA | 1433 | UUCACAAAAGAUUCUUGAU | 1434 |
| NM_005080_1745-1763 | UCCUGCUAGUGUAGCUUCU | 1435 | AGAAGCUACACUAGCAGGA | 1436 |
| NM_005080_138-156 | CCCGGCCGGCCAGGCCCUG | 1437 | CAGGGCCUGGCCGGCCGGG | 1438 |
| NM_005080_145-163 | GGCCAGGCCCUGCCGCUCA | 1439 | UGAGCGGCAGGGCCUGGCC | 1440 |
| NM_005080_190-208 | CCGGAGGCAGCGAGCGGGG | 1441 | CCCCGCUCGCUGCCUCCGG | 1442 |
| NM_005080_191-209 | CGGAGGCAGCGAGCGGGGG | 1443 | CCCCCGCUCGCUGCCUCCG | 1444 |
| NM_005080_192-210 | GGAGGCAGCGAGCGGGGGG | 1445 | CCCCCCGCUCGCUGCCUCC | 1446 |
| NM_005080_259-277 | GAGAAGGCGCUGAGGAGGA | 1447 | UCCUCCUCAGCGCCUUCUC | 1448 |
| NM_005080_261-279 | GAAGGCGCUGAGGAGGAAA | 1449 | UUUCCUCCUCAGCGCCUUC | 1450 |
| NM_005080_289-307 | AGAGUAGCAGCUCAGACUG | 1451 | CAGUCUGAGCUGCUACUCU | 1452 |
| NM_005080_363-381 | AGAAGAAGAACCAAAAA | 1453 | TTTTTGGTTCTCTTCTTCT | 1454 |
| NM_005080_365-383 | AAGAAGAGAACCAAAAACU | 1455 | AGUUUUUGGUUCUCUUCUU | 1456 |
| NM_005080_385-403 | UUGCUAGAAAAUCAGCUUU | 1457 | AAAGCUGAUUUUCUAGCAA | 1458 |
| NM_005080_461-479 | GGAUGGAUGCCCUGGUUGC | 1459 | GCAACCAGGGCAUCCAUCC | 1460 |
| NM_005080_490-508 | GCGGAAGCCAAGGGGAAUG | 1461 | CAUUCCCCUUGGCUUCCGC | 1462 |
| NM_005080_518-536 | CAGUGGCCGGGUCUGCUGA | 1463 | UCAGCAGACCCGGCCACUG | 1464 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_673-691 | ACAACUUGGACCCAGUCAU | 1465 | AUGACUGGGUCCAAGUUGU | 1466 |
| NM_005080_685-703 | CAGUCAUGUUCUUCAAAUG | 1467 | CAUUUGAAGAACAUGACUG | 1468 |
| NM_005080_730-748 | AGGAGCUCCCAGAGGUCUA | 1469 | UAGACCUCUGGGAGCUCCU | 1470 |
| NM_005080_772-790 | CAGCCUCCCUUUCUCUGUC | 1471 | GACAGAGAAAGGGAGGCUG | 1472 |
| NM_005080_801-819 | UCAUCAGCCAAGCUGGAAG | 1473 | CUUCCAGCUUGGCUGAUGA | 1474 |
| NM_005080_817-835 | AAGCCAUUAAUGAACUAAU | 1475 | AUUAGUUCAUUAAUGGCUU | 1476 |
| NM_005080_887-905 | GACAGAGAGCCAAGCUAAU | 1477 | AUUAGCUUGGCUCUCUGUC | 1478 |
| NM_005080_924-942 | GAAGCACCUCUCAGCCCCU | 1479 | AGGGGCUGAGAGGUGCUUC | 1480 |
| NM_005080_927-945 | GCACCUCUCAGCCCCUCAG | 1481 | CUGAGGGGCUGAGAGGUGC | 1482 |
| NM_005080_928-946 | CACCUCUCAGCCCCUCAGA | 1483 | UCUGAGGGGCUGAGAGGUG | 1484 |
| NM_005080_974-992 | AGUGAAGGAAGAACCUGUA | 1485 | UACAGGUUCUUCCUUCACU | 1486 |
| NM_005080_985-1003 | AACCUGUAGAAGAUGACCU | 1487 | AGGUCAUCUUCUACAGGUU | 1488 |
| NM_005080_187-205 | AGCCGGAGGCAGCGAGCG | 1489 | CGCTCGCTGCCTCCGGGCT | 1490 |
| NM_005080_672-690 | GACAACUUGGACCCAGUCA | 1491 | UGACUGGGUCCAAGUUGUC | 1492 |
| NM_005080_771-789 | CCAGCCUCCCUUUCUCUGU | 1493 | ACAGAGAAAGGGAGGCUGG | 1494 |
| NM_005080_1740-1758 | UUUUUUCCUGCUAGUGUAG | 1495 | CUACACUAGCAGGAAAAAA | 1496 |
| NM_005080_1741-1759 | UUUUUCCUGCUAGUGUAGC | 1497 | GCUACACUAGCAGGAAAAA | 1498 |
| NM_005080_662-680 | GGGCAUUCUGGACAACUUG | 1499 | CAAGUUGUCCAGAAUGCCC | 1500 |
| NM_005080_1070-1088 | ACUGGAUGCUUACAGUGAC | 1501 | GUCACUGUAAGCAUCCAGU | 1502 |
| NM_005080_631-649 | ACUCUUCAGAUUCAGAGUC | 1503 | GACUCUGAAUCUGAAGAGU | 1504 |
| NM_005080_647-665 | GUCUGAUAUCCUGUUGGGC | 1505 | GCCCAACAGGAUAUCAGAC | 1506 |
| NM_005080_791-809 | AGUGGGGACGUCAUCAGCC | 1507 | GGCUGAUGACGUCCCCACU | 1508 |
| NM_005080_981-999 | GAAGAACCUGUAGAAGAUG | 1509 | CAUCUUCUACAGGUUCUUC | 1510 |
| NM_005080_1068-1086 | CUACUGGAUGCUUACAGUG | 1511 | CACUGUAAGCAUCCAGUAG | 1512 |
| NM_005080_1391-1409 | GUAUUGAGACAUAUUACUG | 1513 | CAGUAAUAUGUCUCAAUAC | 1514 |
| NM_005080_1426-1444 | CUAUAAUUGAGAACUACAG | 1515 | CUGUAGUUCUCAAUUAUAG | 1516 |
| NM_005080_103-121 | CUUCUGUCGGGGCAGCCCG | 1517 | CGGGCUGCCCCGACAGAAG | 1518 |
| NM_005080_1457-1475 | UACUUUUAUCUUAAAAGGG | 1519 | CCCUUUUAAGAUAAAAGUA | 1520 |
| NM_005080_1568-1586 | CUCUUCCCCCUUUUUGGCA | 1521 | UGCCAAAAAGGGGGAAGAG | 1522 |
| NM_005080_1574-1592 | CCCCUUUUUGGCAUCCUGG | 1523 | CCAGGAUGCCAAAAAGGGG | 1524 |
| NM_005080_1577-1595 | CUUUUUGGCAUCCUGGCUU | 1525 | AAGCCAGGAUGCCAAAAAG | 1526 |
| NM_005080_1730-1748 | CUUGAUGGAAUUUUUUCCU | 1527 | AGGAAAAAAUUCCAUCAAG | 1528 |
| NM_005080_1731-1749 | UUGAUGGAAUUUUUUCCUG | 1529 | CAGGAAAAAAUUCCAUCAA | 1530 |
| NM_005080_1732-1750 | UGAUGGAAUUUUUUCCUGC | 1531 | GCAGGAAAAAAUUCCAUCA | 1532 |
| NM_005080_293-311 | UAGCAGCUCAGACUGCCAG | 1533 | CUGGCAGUCUGAGCUGCUA | 1534 |
| NM_005080_350-368 | AAGUGGUAGAUUUAGAAGA | 1535 | UCUUCUAAAUCUACCACUU | 1536 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_351-369 | AGUGGUAGAUUUAGAAGAA | 1537 | UUCUUCUAAAUCUACCACU | 1538 |
| NM_005080_630-648 | GACUCUUCAGAUUCAGAGU | 1539 | ACUCUGAAUCUGAAGAGUC | 1540 |
| NM_005080_657-675 | CUGUUGGGCAUUCUGGACA | 1541 | UGUCCAGAAUGCCCAACAG | 1542 |
| NM_005080_670-688 | UGGACAACUUGGACCCAGU | 1543 | ACUGGGUCCAAGUUGUCCA | 1544 |
| NM_005080_692-710 | GUUCUUCAAAUGCCCUUCC | 1545 | GGAAGGGCAUUUGAAGAAC | 1546 |
| NM_005080_778-796 | CCCUUUCUCUGUCAGUGGG | 1547 | CCCACUGACAGAGAAAGGG | 1548 |
| NM_005080_790-808 | CAGUGGGGACGUCAUCAGC | 1549 | GCUGAUGACGUCCCCACUG | 1550 |
| NM_005080_970-988 | UCUCAGUGAAGGAAGAACC | 1551 | GGUUCUUCCUUCACUGAGA | 1552 |
| NM_005080_1162-1180 | ACACUUUUGCCAAUGAACU | 1553 | AGUUCAUUGGCAAAAGUGU | 1554 |
| NM_005080_1368-1386 | CUUUUGACAUCCAGCAGUC | 1555 | GACUGCUGGAUGUCAAAAG | 1556 |
| NM_005080_1515-1533 | UAGACAAAUGUCUUGAAGU | 1557 | ACUUCAAGACAUUUGUCUA | 1558 |
| NM_005080_1541-1559 | GAAUUUAUGAAUGGUUCUU | 1559 | AAGAACCAUUCAUAAAUUC | 1560 |
| NM_005080_1542-1560 | AAUUUAUGAAUGGUUCUUU | 1561 | AAAGAACCAUUCAUAAAUU | 1562 |
| NM_005080_1571-1589 | UUCCCCCUUUUUGGCAUCC | 1563 | GGAUGCCAAAAAGGGGGAA | 1564 |
| NM_005080_151-169 | GCCCUGCCGCUCAUGGUGC | 1565 | GCACCAUGAGCGGCAGGGC | 1566 |
| NM_005080_160-178 | CUCAUGGUGCCAGCCCAGA | 1567 | UCUGGGCUGGCACCAUGAG | 1568 |
| NM_005080_326-344 | CUCGAAUGAGUGAGCUGGA | 1569 | UCCAGCUCACUCAUUCGAG | 1570 |
| NM_005080_327-345 | UCGAAUGAGUGAGCUGGAA | 1571 | UUCCAGCUCACUCAUUCGA | 1572 |
| NM_005080_331-349 | AUGAGUGAGCUGGAACAGC | 1573 | GCUGUUCCAGCUCACUCAU | 1574 |
| NM_005080_424-442 | CUUGUAGUUGAGAACCAGG | 1575 | CCUGGUUCUCAACUACAAG | 1576 |
| NM_005080_483-501 | AGAGGAGGCGGAAGCCAAG | 1577 | CTTGGCTTCCGCCTCCTCT | 1578 |
| NM_005080_579-597 | GGCCCAGUUGUCACCCCUC | 1579 | GAGGGGUGACAACUGGGCC | 1580 |
| NM_005080_745-763 | UCUACCCAGAAGGACCCAG | 1581 | CUGGGUCCUUCUGGGUAGA | 1582 |
| NM_005080_746-764 | CUACCCAGAAGGACCCAGU | 1583 | ACUGGGUCCUUCUGGGUAG | 1584 |
| NM_005080_812-830 | GCUGGAAGCCAUUAAUGAA | 1585 | UUCAUUAAUGGCUUCCAGC | 1586 |
| NM_005080_871-889 | UAGAGAUACCCUCUGAGAC | 1587 | GUCUCAGAGGGUAUCUCUA | 1588 |
| NM_005080_892-910 | AGAGCCAAGCUAAUGUGGU | 1589 | ACCACAUUAGCUUGGCUCU | 1590 |
| NM_005080_978-996 | AAGGAAGAACCUGUAGAAG | 1591 | CUUCUACAGGUUCUUCCUU | 1592 |
| NM_005080_982-1000 | AAGAACCUGUAGAAGAUGA | 1593 | UCAUCUUCUACAGGUUCUU | 1594 |
| NM_005080_257-275 | AGGAGAAGGCGCUGAGGAG | 1595 | CUCCUCAGCGCCUUCUCCU | 1596 |
| NM_005080_364-382 | GAAGAAGAGAACCAAAAAC | 1597 | GTTTTTGGTTCTCTTCTTC | 1598 |
| NM_005080_816-834 | GAAGCCAUUAAUGAACUAA | 1599 | UUAGUUCAUUAAUGGCUUC | 1600 |
| NM_005080_884-902 | UGAGACAGAGAGCCAAGCU | 1601 | AGCUUGGCUCUCUGUCUCA | 1602 |
| NM_005080_925-943 | AAGCACCUCUCAGCCCCUC | 1603 | GAGGGGCUGAGAGGUGCUU | 1604 |
| NM_005080_1440-1458 | UACAGCUUUUAAGAUUGUA | 1605 | UACAAUCUUAAAAGCUGUA | 1606 |
| NM_005080_784-802 | CUCUGUCAGUGGGGACGUC | 1607 | GACGUCCCCACUGACAGAG | 1608 |
| NM_005080_1593-1611 | CUUGCCUCCAGUUUUAGGU | 1609 | ACCUAAAACUGGAGGCAAG | 1610 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_301-319 | CAGACUGCCAGAGAUCGAA | 1611 | UUCGAUCUCUGGCAGUCUG | 1612 |
| NM_005080_674-692 | CAACUUGGACCCAGUCAUG | 1613 | CAUGACUGGGUCCAAGUUG | 1614 |
| NM_005080_783-801 | UCUCUGUCAGUGGGGACGU | 1615 | ACGUCCCCACUGACAGAGA | 1616 |
| NM_005080_921-939 | GAGGAAGCACCUCUCAGCC | 1617 | GGCUGAGAGGUGCUUCCUC | 1618 |
| NM_005080_1226-1244 | CCCUUUUCCUUGACUAUUA | 1619 | UAAUAGUCAAGGAAAAGGG | 1620 |
| NM_005080_1283-1301 | CAUUCAAAAAGCCAAAAUA | 1621 | UAUUUUGGCUUUUUGAAUG | 1622 |
| NM_005080_1416-1434 | AGAAAUAUUACUAUAAUUG | 1623 | CAAUUAUAGUAAUAUUUCU | 1624 |
| NM_005080_1420-1438 | AUAUUACUAUAAUUGAGAA | 1625 | UUCUCAAUUAUAGUAAUAU | 1626 |
| NM_005080_1488-1506 | CUAAAAUACUUAUUAUGUA | 1627 | UACAUAAUAAGUAUUUUAG | 1628 |
| NM_005080_1492-1510 | AAUACUUAUUAUGUAAGGG | 1629 | CCCUUACAUAAUAAGUAUU | 1630 |
| NM_005080_111-129 | GGGGCAGCCCGCCUCCGCC | 1631 | GGCGGAGGCGGGCUGCCCC | 1632 |
| NM_005080_1639-1657 | GAACACCUGCUGAGGGGGC | 1633 | GCCCCCUCAGCAGGUGUUC | 1634 |
| NM_005080_1685-1703 | GAUCAAGAAUCUUUUGUGA | 1635 | UCACAAAAGAUUCUUGAUC | 1636 |
| NM_005080_1733-1751 | GAUGGAAUUUUUUCCUGCU | 1637 | AGCAGGAAAAAAUUCCAUC | 1638 |
| NM_005080_1734-1752 | AUGGAAUUUUUUCCUGCUA | 1639 | UAGCAGGAAAAAAUUCCAU | 1640 |
| NM_005080_1737-1755 | GAAUUUUUUCCUGCUAGUG | 1641 | CACUAGCAGGAAAAAAUUC | 1642 |
| NM_005080_1756-1774 | UAGCUUCUGAAAGGUGCUU | 1643 | AAGCACCUUUCAGAAGCUA | 1644 |
| NM_005080_1757-1775 | AGCUUCUGAAAGGUGCUUU | 1645 | AAAGCACCUUUCAGAAGCU | 1646 |
| NM_005080_152-170 | CCCUGCCGCUCAUGGUGCC | 1647 | GGCACCAUGAGCGGCAGGG | 1648 |
| NM_005080_153-171 | CCUGCCGCUCAUGGUGCCA | 1649 | UGGCACCAUGAGCGGCAGG | 1650 |
| NM_005080_163-181 | AUGGUGCCAGCCCAGAGAG | 1651 | CUCUCUGGGCUGGCACCAU | 1652 |
| NM_005080_167-185 | UGCCAGCCCAGAGAGGGGC | 1653 | GCCCCUCUCUGGGCUGGCA | 1654 |
| NM_005080_200-218 | CGAGCGGGGGGCUGCCCCA | 1655 | UGGGGCAGCCCCCCGCUCG | 1656 |
| NM_005080_252-270 | CCCCGAGGAGAAGGCGCUG | 1657 | CAGCGCCUUCUCCUCGGGG | 1658 |
| NM_005080_255-273 | CGAGGAGAAGGCGCUGAGG | 1659 | CCUCAGCGCCUUCUCCUCG | 1660 |
| NM_005080_260-278 | AGAAGGCGCUGAGGAGGAA | 1661 | UUCCUCCUCAGCGCCUUCU | 1662 |
| NM_005080_271-289 | AGGAGGAAACUGAAAAACA | 1663 | UGUUUUUCAGUUUCCUCCU | 1664 |
| NM_005080_297-315 | AGCUCAGACUGCCAGAGAU | 1665 | AUCUCUGGCAGUCUGAGCU | 1666 |
| NM_005080_300-318 | UCAGACUGCCAGAGAUCGA | 1667 | UCGAUCUCUGGCAGUCUGA | 1668 |
| NM_005080_335-353 | GUGAGCUGGAACAGCAAGU | 1669 | ACUUGCUGUUCCAGCUCAC | 1670 |
| NM_005080_368-386 | AAGAGAACCAAAAACUUUU | 1671 | AAAAGUUUUUGGUUCUCUU | 1672 |
| NM_005080_378-396 | AAAACUUUUGCUAGAAAAU | 1673 | AUUUUCUAGCAAAAGUUUU | 1674 |
| NM_005080_379-397 | AAACUUUUGCUAGAAAAUC | 1675 | GAUUUUCUAGCAAAAGUUU | 1676 |
| NM_005080_380-398 | AACUUUUGCUAGAAAAUCA | 1677 | UGAUUUUCUAGCAAAAGUU | 1678 |
| NM_005080_389-407 | UAGAAAAUCAGCUUUUACG | 1679 | CGUAAAAGCUGAUUUUCUA | 1680 |
| NM_005080_426-444 | UGUAGUUGAGAACCAGGAG | 1681 | CUCCUGGUUCUCAACUACA | 1682 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_427-445 | GUAGUUGAGAACCAGGAGU | 1683 | ACUCCUGGUUCUCAACUAC | 1684 |
| NM_005080_485-503 | AGGAGGCGGAAGCCAAGGG | 1685 | CCCUUGGCUUCCGCCUCCU | 1686 |
| NM_005080_487-505 | GAGGCGGAAGCCAAGGGGA | 1687 | TCCCCUUGGCUUCCGCCUC | 1688 |
| NM_005080_488-506 | AGGCGGAAGCCAAGGGGAA | 1689 | TTCCCCUUGGCUUCCGCCU | 1690 |
| NM_005080_511-529 | GUGAGGCCAGUGGCCGGGU | 1691 | ACCCGGCCACUGGCCUCAC | 1692 |
| NM_005080_526-544 | GGGUCUGCUGAGUCCGCAG | 1693 | CUGCGGACUCAGCAGACCC | 1694 |
| NM_005080_575-593 | UGCAGGCCCAGUUGUCACC | 1695 | GGUGACAACUGGGCCUGCA | 1696 |
| NM_005080_593-611 | CCCUCCAGAACAUCUCCCC | 1697 | GGGGAGAUGUUCUGGAGGG | 1698 |
| NM_005080_595-613 | CUCCAGAACAUCUCCCCAU | 1699 | AUGGGGAGAUGUUCUGGAG | 1700 |
| NM_005080_654-672 | AUCCUGUUGGGCAUUCUGG | 1701 | CCAGAAUGCCCAACAGGAU | 1702 |
| NM_005080_675-693 | AACUUGGACCCAGUCAUGU | 1703 | ACAUGACUGGGUCCAAGUU | 1704 |
| NM_005080_683-701 | CCCAGUCAUGUUCUUCAAA | 1705 | UUUGAAGAACAUGACUGGG | 1706 |
| NM_005080_684-702 | CCAGUCAUGUUCUUCAAAU | 1707 | AUUUGAAGAACAUGACUGG | 1708 |
| NM_005080_693-711 | UUCUUCAAAUGCCCUUCCC | 1709 | GGGAAGGGCAUUUGAAGAA | 1710 |
| NM_005080_694-712 | UCUUCAAAUGCCCUUCCCC | 1711 | GGGGAAGGGCAUUUGAAGA | 1712 |
| NM_005080_726-744 | CUGGAGGAGCUCCCAGAGG | 1713 | CCUCUGGGAGCUCCUCCAG | 1714 |
| NM_005080_744-762 | GUCUACCCAGAAGGACCCA | 1715 | UGGGUCCUUCUGGGUAGAC | 1716 |
| NM_005080_765-783 | UCCUUACCAGCCUCCCUUU | 1717 | AAAGGGAGGCUGGUAAGGA | 1718 |
| NM_005080_768-786 | UUACCAGCCUCCCUUUCUC | 1719 | GAGAAAGGGAGGCUGGUAA | 1720 |
| NM_005080_777-795 | UCCCUUUCUCUGUCAGUGG | 1721 | CCACUGACAGAGAAAGGGA | 1722 |
| NM_005080_802-820 | CAUCAGCCAAGCUGGAAGC | 1723 | GCUUCCAGCUUGGCUGAUG | 1724 |
| NM_005080_877-895 | UACCCUCUGAGACAGAGAG | 1725 | CUCUCUGUCUCAGAGGGUA | 1726 |
| NM_005080_878-896 | ACCCUCUGAGACAGAGAGC | 1727 | GCUCUCUGUCUCAGAGGGU | 1728 |
| NM_005080_885-903 | GAGACAGAGAGCCAAGCUA | 1729 | UAGCUUGGCUCUCUGUCUC | 1730 |
| NM_005080_886-904 | AGACAGAGAGCCAAGCUAA | 1731 | UUAGCUUGGCUCUCUGUCU | 1732 |
| NM_005080_966-984 | AUUGUCUCAGUGAAGGAAG | 1733 | CUUCCUUCACUGAGACAAU | 1734 |
| NM_005080_969-987 | GUCUCAGUGAAGGAAGAAC | 1735 | GUUCUUCCUUCACUGAGAC | 1736 |
| NM_005080_1245-1263 | CACUGCCUGGAGGAUAGCA | 1737 | UGCUAUCCUCCAGGCAGUG | 1738 |
| NM_005080_1738-1756 | AAUUUUUUCCUGCUAGUGU | 1739 | ACACUAGCAGGAAAAAAUU | 1740 |
| NM_005080_194-212 | AGGCAGCGAGCGGGGGCU | 1741 | AGCCCCCGCUCGCUGCCU | 1742 |
| NM_005080_209-227 | GGCUGCCCCAGGCGCGCAA | 1743 | UUGCGCGCCUGGGGCAGCC | 1744 |
| NM_005080_269-287 | UGAGGAGGAAACUGAAAAA | 1745 | UUUUUCAGUUUCCUCCUCA | 1746 |
| NM_005080_902-920 | UAAUGUGGUAGUGAAAAUC | 1747 | GAUUUUCACUACCACAUUA | 1748 |
| NM_005080_50-68 | UGGUGGUGGUGGCAGCCGC | 1749 | GCGGCUGCCACCACCACCA | 1750 |
| NM_005080_1017-1035 | GGUAUCUCAAAUCUGCUUU | 1751 | AAAGCAGAUUUGAGAUACC | 1752 |
| NM_005080_1021-1039 | UCUCAAAUCUGCUUUCAUC | 1753 | GAUGAAAGCAGAUUUGAGA | 1754 |
| NM_005080_1022-1040 | CUCAAAUCUGCUUUCAUCC | 1755 | GGAUGAAAGCAGAUUUGAG | 1756 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_1062-1080 | UCCUGCCUACUGGAUGCUU | 1757 | AAGCAUCCAGUAGGCAGGA | 1758 |
| NM_005080_1074-1092 | GAUGCUUACAGUGACUGUG | 1759 | CACAGUCACUGUAAGCAUC | 1760 |
| NM_005080_1116-1134 | UUCAGUGACAUGUCCUCUC | 1761 | GAGAGGACAUGUCACUGAA | 1762 |
| NM_005080_1149-1167 | CAUUCUUGGGAGGACACUU | 1763 | AAGUGUCCUCCCAAGAAUG | 1764 |
| NM_005080_1150-1168 | AUUCUUGGGAGGACACUUU | 1765 | AAAGUGUCCUCCCAAGAAU | 1766 |
| NM_005080_1161-1179 | GACACUUUUGCCAAUGAAC | 1767 | GUUCAUUGGCAAAAGUGUC | 1768 |
| NM_005080_1223-1241 | UUGCCCUUUUCCUUGACUA | 1769 | UAGUCAAGGAAAAGGGCAA | 1770 |
| NM_005080_1280-1298 | CUUCAUUCAAAAAGCCAAA | 1771 | UUUGGCUUUUUGAAUGAAG | 1772 |
| NM_005080_1281-1299 | UUCAUUCAAAAAGCCAAAA | 1773 | UUUUGGCUUUUUGAAUGAA | 1774 |
| NM_005080_1284-1302 | AUUCAAAAAGCCAAAAUAG | 1775 | CUAUUUUGGCUUUUUGAAU | 1776 |
| NM_005080_1286-1304 | UCAAAAAGCCAAAAUAGAG | 1777 | CUCUAUUUUGGCUUUUUGA | 1778 |
| NM_005080_1288-1306 | AAAAAGCCAAAAUAGAGAG | 1779 | CUCUCUAUUUUGGCUUUUU | 1780 |
| NM_005080_1365-1383 | UGUCUUUUGACAUCCAGCA | 1781 | UGCUGGAUGUCAAAAGACA | 1782 |
| NM_005080_1417-1435 | GAAAUAUUACUAUAAUUGA | 1783 | UCAAUUAUAGUAAUAUUUC | 1784 |
| NM_005080_1421-1439 | UAUUACUAUAAUUGAGAAC | 1785 | GUUCUCAAUUAUAGUAAUA | 1786 |
| NM_005080_1434-1452 | GAGAACUACAGCUUUUAAG | 1787 | CUUAAAAGCUGUAGUUCUC | 1788 |
| NM_005080_1452-1470 | GAUUGUACUUUUAUCUUAA | 1789 | UUAAGAUAAAAGUACAAUC | 1790 |
| NM_005080_105-123 | UCUGUCGGGGCAGCCCGCC | 1791 | GGCGGGCUGCCCCGACAGA | 1792 |
| NM_005080_1455-1473 | UGUACUUUUAUCUUAAAAG | 1793 | CUUUUAAGAUAAAAGUACA | 1794 |
| NM_005080_112-130 | GGGCAGCCCGCCUCCGCCG | 1795 | CGGCGGAGGCGGGCUGCCC | 1796 |
| NM_005080_113-131 | GGCAGCCCGCCUCCGCCGC | 1797 | GCGGCGGAGGCGGGCUGCC | 1798 |
| NM_005080_1543-1561 | AUUUAUGAAUGGUUCUUUA | 1799 | UAAAGAACCAUUCAUAAAU | 1800 |
| NM_005080_1544-1562 | UUUAUGAAUGGUUCUUUAU | 1801 | AUAAAGAACCAUUCAUAAA | 1802 |
| NM_005080_1557-1575 | CUUUAUCAUUUCUCUUCCC | 1803 | GGGAAGAGAAAUGAUAAAG | 1804 |
| NM_005080_115-133 | CAGCCCGCCUCCGCCGCCG | 1805 | CGGCGGCGGAGGCGGGCUG | 1806 |
| NM_005080_1564-1582 | AUUUCUCUUCCCCCUUUUU | 1807 | AAAAAGGGGGAAGAGAAAU | 1808 |
| NM_005080_1572-1590 | UCCCCCUUUUUGGCAUCCU | 1809 | AGGAUGCCAAAAAGGGGGA | 1810 |
| NM_005080_1575-1593 | CCCUUUUUGGCAUCCUGGC | 1811 | GCCAGGAUGCCAAAAAGGG | 1812 |
| NM_005080_1576-1594 | CCUUUUUGGCAUCCUGGCU | 1813 | AGCCAGGAUGCCAAAAAGG | 1814 |
| NM_005080_117-135 | GCCCGCCUCCGCCGCCGGA | 1815 | UCCGGCGGCGGAGGCGGGC | 1816 |
| NM_005080_1582-1600 | UGGCAUCCUGGCUUGCCUC | 1817 | GAGGCAAGCCAGGAUGCCA | 1818 |
| NM_005080_1587-1605 | UCCUGGCUUGCCUCCAGUU | 1819 | AACUGGAGGCAAGCCAGGA | 1820 |
| NM_005080_118-136 | CCCGCCUCCGCCGCCGGAG | 1821 | CUCCGGCGGCGGAGGCGGG | 1822 |
| NM_005080_119-137 | CCGCCUCCGCCGCCGGAGC | 1823 | GCUCCGGCGGCGGAGGCGG | 1824 |
| NM_005080_120-138 | CGCCUCCGCCGCCGGAGCC | 1825 | GGCUCCGGCGGCGGAGGCG | 1826 |
| NM_005080_124-142 | UCCGCCGCCGGAGCCCCGG | 1827 | CCGGGGCUCCGGCGGCGGA | 1828 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_126-144 | CGCCGCCGGAGCCCCGGCC | 1829 | GGCCGGGGCTCCGGCGGCG | 1830 |
| NM_005080_1676-1694 | UUCAAGUAAGAUCAAGAAU | 1831 | AUUCUUGAUCUUACUUGAA | 1832 |
| NM_005080_127-145 | GCCGCCGGAGCCCCGGCCG | 1833 | CGGCCGGGGCTCCGGCGGC | 1834 |
| NM_005080_129-147 | CGCCGGAGCCCCGGCCGGC | 1835 | GCCGGCCGGGGCTCCGGCG | 1836 |
| NM_005080_130-148 | GCCGGAGCCCCGGCCGGCC | 1837 | GGCCGGCCGGGGCTCCGGC | 1838 |
| NM_005080_131-149 | CCGGAGCCCCGGCCGGCCA | 1839 | TGGCCGGCCGGGGCTCCGG | 1840 |
| NM_005080_1720-1738 | UAUGUAAAUGCUUGAUGGA | 1841 | UCCAUCAAGCAUUUACAUA | 1842 |
| NM_005080_1724-1742 | UAAAUGCUUGAUGGAAUUU | 1843 | AAAUUCCAUCAAGCAUUUA | 1844 |
| NM_005080_132-150 | CGGAGCCCCGGCCGGCCAG | 1845 | CTGGCCGGCCGGGGCTCCG | 1846 |
| NM_005080_133-151 | GGAGCCCCGGCCGGCCAGG | 1847 | CCTGGCCGGCCGGGGCTCC | 1848 |
| NM_005080_134-152 | GAGCCCCGGCCGGCCAGGC | 1849 | GCCTGGCCGGCCGGGGCTC | 1850 |
| NM_005080_136-154 | GCCCCGGCCGGCCAGGCCC | 1851 | GGGCCTGGCCGGCCGGGGC | 1852 |
| NM_005080_1777-1795 | UCCAUUUAUUUAAAACUAC | 1853 | GUAGUUUUAAAUAAAUGGA | 1854 |
| NM_005080_137-155 | CCCCGGCCGGCCAGGCCCU | 1855 | AGGGCCUGGCCGGCCGGGG | 1856 |
| NM_005080_139-157 | CCGGCCGGCCAGGCCCUGC | 1857 | GCAGGGCCUGGCCGGCCGG | 1858 |
| NM_005080_140-158 | CGGCCGGCCAGGCCCUGCC | 1859 | GGCAGGGCCUGGCCGGCCG | 1860 |
| NM_005080_141-159 | GGCCGGCCAGGCCCUGCCG | 1861 | CGGCAGGGCCUGGCCGGCC | 1862 |
| NM_005080_142-160 | GCCGGCCAGGCCCUGCCGC | 1863 | GCGGCAGGGCCUGGCCGGC | 1864 |
| NM_005080_143-161 | CCGGCCAGGCCCUGCCGCU | 1865 | AGCGGCAGGGCCUGGCCGG | 1866 |
| NM_005080_144-162 | CGGCCAGGCCCUGCCGCUC | 1867 | GAGCGGCAGGGCCUGGCCG | 1868 |
| NM_005080_161-179 | UCAUGGUGCCAGCCCAGAG | 1869 | CUCUGGGCUGGCACCAUGA | 1870 |
| NM_005080_162-180 | CAUGGUGCCAGCCCAGAGA | 1871 | UCUCUGGGCUGGCACCAUG | 1872 |
| NM_005080_164-182 | UGGUGCCAGCCCAGAGAGG | 1873 | CCUCUCUGGGCUGGCACCA | 1874 |
| NM_005080_165-183 | GGUGCCAGCCCAGAGAGGG | 1875 | CCCUCUCUGGGCUGGCACC | 1876 |
| NM_005080_166-184 | GUGCCAGCCCAGAGAGGGG | 1877 | CCCCUCUCUGGGCUGGCAC | 1878 |
| NM_005080_201-219 | GAGCGGGGGCUGCCCCAG | 1879 | CUGGGGCAGCCCCCGCUC | 1880 |
| NM_005080_202-220 | AGCGGGGGCUGCCCCAGG | 1881 | CCUGGGGCAGCCCCCGCU | 1882 |
| NM_005080_203-221 | GCGGGGGCUGCCCCAGGC | 1883 | GCCUGGGGCAGCCCCCGC | 1884 |
| NM_005080_204-222 | CGGGGGCUGCCCCAGGCG | 1885 | CGCCUGGGGCAGCCCCCG | 1886 |
| NM_005080_208-226 | GGGCUGCCCCAGGCGCGCA | 1887 | UGCGCGCCUGGGGCAGCCC | 1888 |
| NM_005080_212-230 | UGCCCCAGGCGCGCAAGCG | 1889 | CGCUUGCGCGCCUGGGGCA | 1890 |
| NM_005080_248-266 | UGAGCCCCGAGGAGAAGGC | 1891 | GCCUUCUCCUCGGGGCUCA | 1892 |
| NM_005080_251-269 | GCCCCGAGGAGAAGGCGCU | 1893 | AGCGCCUUCUCCUCGGGGC | 1894 |
| NM_005080_258-276 | GGAGAAGGCGCUGAGGAGG | 1895 | CCUCCUCAGCGCCUUCUCC | 1896 |
| NM_005080_262-280 | AAGGCGCUGAGGAGGAAAC | 1897 | GUUUCCUCCUCAGCGCCUU | 1898 |
| NM_005080_265-283 | GCGCUGAGGAGGAAACUGA | 1899 | UCAGUUUCCUCCUCAGCGC | 1900 |
| NM_005080_266-284 | CGCUGAGGAGGAAACUGAA | 1901 | UUCAGUUUCCUCCUCAGCG | 1902 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_267-285 | GCUGAGGAGGAAACUGAAA | 1903 | UUUCAGUUUCCUCCUCAGC | 1904 |
| NM_005080_268-286 | CUGAGGAGGAAACUGAAAA | 1905 | UUUUCAGUUUCCUCCUCAG | 1906 |
| NM_005080_270-288 | GAGGAGGAAACUGAAAAAC | 1907 | GUUUUUCAGUUUCCUCCUC | 1908 |
| NM_005080_272-290 | GGAGGAAACUGAAAAACAG | 1909 | CUGUUUUUCAGUUUCCUCC | 1910 |
| NM_005080_273-291 | GAGGAAACUGAAAAACAGA | 1911 | UCUGUUUUUCAGUUUCCUC | 1912 |
| NM_005080_277-295 | AAACUGAAAAACAGAGUAG | 1913 | CUACUCUGUUUUUCAGUUU | 1914 |
| NM_005080_328-346 | CGAAUGAGUGAGCUGGAAC | 1915 | GUUCCAGCUCACUCAUUCG | 1916 |
| NM_005080_329-347 | GAAUGAGUGAGCUGGAACA | 1917 | UGUUCCAGCUCACUCAUUC | 1918 |
| NM_005080_334-352 | AGUGAGCUGGAACAGCAAG | 1919 | CUUGCUGUUCCAGCUCACU | 1920 |
| NM_005080_336-354 | UGAGCUGGAACAGCAAGUG | 1921 | CACUUGCUGUUCCAGCUCA | 1922 |
| NM_005080_337-355 | GAGCUGGAACAGCAAGUGG | 1923 | CCACUUGCUGUUCCAGCUC | 1924 |
| NM_005080_338-356 | AGCUGGAACAGCAAGUGGU | 1925 | ACCACUUGCUGUUCCAGCU | 1926 |
| NM_005080_356-374 | UAGAUUUAGAAGAAGAGAA | 1927 | UUCUCUUCUUCUAAAUCUA | 1928 |
| NM_005080_357-375 | AGAUUUAGAAGAAGAGAAC | 1929 | GUUCUCUUCUUCUAAAUCU | 1930 |
| NM_005080_359-377 | AUUUAGAAGAAGAGAACCA | 1931 | UGGUUCUCUUCUUCUAAAU | 1932 |
| NM_005080_360-378 | UUUAGAAGAAGAGAACCAA | 1933 | UUGGUUCUCUUCUUCUAAA | 1934 |
| NM_005080_362-380 | UAGAAGAAGAGAACCAAAA | 1935 | UUUUGGUUCUCUUCUUCUA | 1936 |
| NM_005080_367-385 | GAAGAGAACCAAAAACUUU | 1937 | AAAGUUUUUGGUUCUCUUC | 1938 |
| NM_005080_382-400 | CUUUUGCUAGAAAAUCAGC | 1939 | GCUGAUUUUCUAGCAAAAG | 1940 |
| NM_005080_386-404 | UGCUAGAAAAUCAGCUUUU | 1941 | AAAAGCUGAUUUUCUAGCA | 1942 |
| NM_005080_401-419 | UUUUACGAGAGAAAACUCA | 1943 | UGAGUUUUCUCUCGUAAAA | 1944 |
| NM_005080_458-476 | UGGGGAUGGAUGCCCUGGU | 1945 | ACCAGGGCAUCCAUCCCCA | 1946 |
| NM_005080_484-502 | GAGGAGGCGGAAGCCAAGG | 1947 | CCTTGGCTTCCGCCTCCTC | 1948 |
| NM_005080_489-507 | GGCGGAAGCCAAGGGGAAU | 1949 | AUUCCCCUUGGCUUCCGCC | 1950 |
| NM_005080_574-592 | GUGCAGGCCCAGUUGUCAC | 1951 | GUGACAACUGGGCCUGCAC | 1952 |
| NM_005080_594-612 | CCUCCAGAACAUCUCCCCA | 1953 | UGGGGAGAUGUUCUGGAGG | 1954 |
| NM_005080_604-622 | AUCUCCCCAUGGAUUCUGG | 1955 | CCAGAAUCCAUGGGGAGAU | 1956 |
| NM_005080_627-645 | AUUGACUCUUCAGAUUCAG | 1957 | CUGAAUCUGAAGAGUCAAU | 1958 |
| NM_005080_635-653 | UUCAGAUUCAGAGUCUGAU | 1959 | AUCAGACUCUGAAUCUGAA | 1960 |
| NM_005080_636-654 | UCAGAUUCAGAGUCUGAUA | 1961 | UAUCAGACUCUGAAUCUGA | 1962 |
| NM_005080_666-684 | AUUCUGGACAACUUGGACC | 1963 | GGUCCAAGUUGUCCAGAAU | 1964 |
| NM_005080_667-685 | UUCUGGACAACUUGGACCC | 1965 | GGGUCCAAGUUGUCCAGAA | 1966 |
| NM_005080_669-687 | CUGGACAACUUGGACCCAG | 1967 | CUGGGUCCAAGUUGUCCAG | 1968 |
| NM_005080_681-699 | GACCCAGUCAUGUUCUUCA | 1969 | UGAAGAACAUGACUGGGUC | 1970 |
| NM_005080_690-708 | AUGUUCUUCAAAUGCCCUU | 1971 | AAGGGCAUUUGAAGAACAU | 1972 |

TABLE 8-continued

XBP-1 human/Rhesus siRNAs

| Oligo Name/ Positions on target sequence (5'to 3') | sense (5'-3') | SEQ ID NO: | antisense (5'-3') | SEQ ID NO: |
|---|---|---|---|---|
| NM_005080_718-736 | CUGCCAGCCUGGAGGAGCU | 1973 | AGCUCCUCCAGGCUGGCAG | 1974 |
| NM_005080_722-740 | CAGCCUGGAGGAGCUCCCA | 1975 | UGGGAGCUCCUCCAGGCUG | 1976 |
| NM_005080_723-741 | AGCCUGGAGGAGCUCCCAG | 1977 | CUGGGAGCUCCUCCAGGCU | 1978 |
| NM_005080_724-742 | GCCUGGAGGAGCUCCCAGA | 1979 | UCUGGGAGCUCCUCCAGGC | 1980 |
| NM_005080_725-743 | CCUGGAGGAGCUCCCAGAG | 1981 | CUCUGGGAGCUCCUCCAGG | 1982 |
| NM_005080_727-745 | UGGAGGAGCUCCCAGAGGU | 1983 | ACCUCUGGGAGCUCCUCCA | 1984 |
| NM_005080_728-746 | GGAGGAGCUCCCAGAGGUC | 1985 | GACCUCUGGGAGCUCCUCC | 1986 |
| NM_005080_739-757 | CAGAGGUCUACCCAGAAGG | 1987 | CCUUCUGGGUAGACCUCUG | 1988 |
| NM_005080_747-765 | UACCCAGAAGGACCCAGUU | 1989 | AACUGGGUCCUUCUGGGUA | 1990 |
| NM_005080_763-781 | GUUCCUUACCAGCCUCCCU | 1991 | AGGGAGGCUGGUAAGGAAC | 1992 |
| NM_005080_764-782 | UUCCUUACCAGCCUCCCUU | 1993 | AAGGGAGGCUGGUAAGGAA | 1994 |
| NM_005080_766-784 | CCUUACCAGCCUCCCUUUC | 1995 | GAAAGGGAGGCUGGUAAGG | 1996 |
| NM_005080_770-788 | ACCAGCCUCCCUUUCUCUG | 1997 | CAGAGAAAGGGAGGCUGGU | 1998 |
| NM_005080_774-792 | GCCUCCCUUUCUCUGUCAG | 1999 | CUGACAGAGAAAGGGAGGC | 2000 |
| NM_005080_780-798 | CUUUCUCUGUCAGUGGGGA | 2001 | UCCCCACUGACAGAGAAAG | 2002 |
| NM_005080_781-799 | UUUCUCUGUCAGUGGGGAC | 2003 | GUCCCCACUGACAGAGAAA | 2004 |
| NM_005080_805-823 | CAGCCAAGCUGGAAGCCAU | 2005 | AUGGCUUCCAGCUUGGCUG | 2006 |
| NM_005080_44-62 | GAGCUAUGGUGGUGGUGGC | 2007 | GCCACCACCACCAUAGCUC | 2008 |
| NM_005080_45-63 | AGCUAUGGUGGUGGUGGCA | 2009 | UGCCACCACCACCAUAGCU | 2010 |
| NM_005080_868-886 | UCUUAGAGAUACCCUCUGA | 2011 | UCAGAGGGUAUCUCUAAGA | 2012 |
| NM_005080_875-893 | GAUACCCUCUGAGACAGAG | 2013 | CUCUGUCUCAGAGGGUAUC | 2014 |
| NM_005080_47-65 | CUAUGGUGGUGGUGGCAGC | 2015 | GCUGCCACCACCACCAUAG | 2016 |
| NM_005080_879-897 | CCCUCUGAGACAGAGAGCC | 2017 | GGCUCUCUGUCUCAGAGGG | 2018 |
| NM_005080_880-898 | CCUCUGAGACAGAGAGCCA | 2019 | UGGCUCUCUGUCUCAGAGG | 2020 |
| NM_005080_881-899 | CUCUGAGACAGAGAGCCAA | 2021 | UUGGCUCUCUGUCUCAGAG | 2022 |
| NM_005080_882-900 | UCUGAGACAGAGAGCCAAG | 2023 | CUUGGCUCUCUGUCUCAGA | 2024 |
| NM_005080_883-901 | CUGAGACAGAGAGCCAAGC | 2025 | GCUUGGCUCUCUGUCUCAG | 2026 |
| NM_005080_49-67 | AUGGUGGUGGUGGCAGCCG | 2027 | CGGCUGCCACCACCACCAU | 2028 |
| NM_005080_914-932 | GAAAAUCGAGGAAGCACCU | 2029 | AGGUGCUUCCUCGAUUUUC | 2030 |
| NM_005080_915-933 | AAAAUCGAGGAAGCACCUC | 2031 | GAGGUGCUUCCUCGAUUUU | 2032 |
| NM_005080_926-944 | AGCACCUCUCAGCCCCUCA | 2033 | UGAGGGGCUGAGAGGUGCU | 2034 |
| NM_005080_945-963 | GAGAAUGAUCACCCUGAAU | 2035 | AUUCAGGGUGAUCAUUCUC | 2036 |
| NM_005080_958-976 | CUGAAUUCAUUGUCUCAGU | 2037 | ACUGAGACAAUGAAUUCAG | 2038 |
| NM_005080_959-977 | UGAAUUCAUUGUCUCAGUG | 2039 | CACUGAGACAAUGAAUUCA | 2040 |
| NM_005080_962-980 | AUUCAUUGUCUCAGUGAAG | 2041 | CUUCACUGAGACAAUGAAU | 2042 |

TABLE 8-continued

XBP-1 human/Rhesus siRNAs

| Oligo Name/ Positions on target sequence (5' to 3') | sense (5'-3') | SEQ ID NO: | antisense (5'-3') | SEQ ID NO: |
|---|---|---|---|---|
| NM_005080_975-993 | GUGAAGGAAGAACCUGUAG | 2043 | CUACAGGUUCUUCCUUCAC | 2044 |
| NM_005080_983-1001 | AGAACCUGUAGAAGAUGAC | 2045 | GUCAUCUUCUACAGGUUCU | 2046 |
| NM_005080_128-146 | CCGCCGGAGCCCCGGCCGG | 2047 | CCGGCCGGGGCUCCGGCGG | 2048 |
| NM_005080_249-267 | GAGCCCCGAGGAGAAGGCG | 2049 | CGCCUUCUCCUCGGGGCUC | 2050 |
| NM_005080_697-715 | UCAAAUGCCCUUCCCCAGA | 2051 | UCUGGGGAAGGGCAUUUGA | 2052 |
| NM_005080_729-747 | GAGGAGCUCCCAGAGGUCU | 2053 | AGACCUCUGGGAGCUCCUC | 2054 |
| NM_005080_776-794 | CUCCCUUUCUCUGUCAGUG | 2055 | CACUGACAGAGAAAGGGAG | 2056 |
| NM_005080_803-821 | AUCAGCCAAGCUGGAAGCC | 2057 | GGCUUCCAGCUUGGCUGAU | 2058 |
| NM_005080_254-272 | CCGAGGAGAAGGCGCUGAG | 2059 | CUCAGCGCCUUCUCCUCGG | 2060 |
| NM_005080_383-401 | UUUUGCUAGAAAAUCAGCU | 2061 | AGCUGAUUUUCUAGCAAAA | 2062 |
| NM_005080_116-134 | AGCCCGCCUCCGCCGCCGG | 2063 | CCGGCGGCGGAGGCGGGCU | 2064 |
| NM_005080_123-141 | CUCCGCCGCCGGAGCCCCG | 2065 | CGGGGCUCCGGCGGCGGAG | 2066 |
| NM_005080_125-143 | CCGCCGCCGGAGCCCCGGC | 2067 | GCCGGGGCUCCGGCGGCGG | 2068 |
| NM_005080_135-153 | AGCCCCGGCCGGCCAGGCC | 2069 | GGCCTGGCCGGCCGGGGCT | 2070 |
| NM_005080_253-271 | CCCGAGGAGAAGGCGCUGA | 2071 | UCAGCGCCUUCUCCUCGGG | 2072 |
| NM_005080_274-292 | AGGAAACUGAAAAACAGAG | 2073 | CUCUGUUUUUCAGUUUCCU | 2074 |
| NM_005080_655-673 | UCCUGUUGGGCAUUCUGGA | 2075 | UCCAGAAUGCCCAACAGGA | 2076 |
| NM_005080_775-793 | CCUCCCUUUCUCUGUCAGU | 2077 | ACUGACAGAGAAAGGGAGG | 2078 |
| NM_005080_46-64 | GCUAUGGUGGUGGUGGCAG | 2079 | CUGCCACCACCACCAUAGC | 2080 |
| NM_005080_1456-1474 | GUACUUUUAUCUUAAAAGG | 2081 | CCUUUUAAGAUAAAAGUAC | 2082 |
| NM_005080_1545-1563 | UUAUGAAUGGUUCUUUAUC | 2083 | GAUAAAGAACCAUUCAUAA | 2084 |
| NM_005080_1558-1576 | UUUAUCAUUUCUCUUCCCC | 2085 | GGGGAAGAGAAAUGAUAAA | 2086 |
| NM_005080_121-139 | GCCUCCGCCGCCGGAGCCC | 2087 | GGGCUCCGGCGGCGGAGGC | 2088 |
| NM_005080_122-140 | CCUCCGCCGCCGGAGCCCC | 2089 | GGGGCUCCGGCGGCGGAGG | 2090 |
| NM_005080_247-265 | CUGAGCCCCGAGGAGAAGG | 2091 | CCUUCUCCUCGGGGCUCAG | 2092 |
| NM_005080_275-293 | GGAAACUGAAAAACAGAGU | 2093 | ACUCUGUUUUUCAGUUUCC | 2094 |
| NM_005080_276-294 | GAAACUGAAAAACAGAGUA | 2095 | UACUCUGUUUUUCAGUUUC | 2096 |
| NM_005080_358-376 | GAUUUAGAAGAAGAGAACC | 2097 | GGUUCUCUUCUUCUAAAUC | 2098 |
| NM_005080_387-405 | GCUAGAAAAUCAGCUUUUA | 2099 | UAAAAGCUGAUUUUCUAGC | 2100 |
| NM_005080_628-646 | UUGACUCUUCAGAUUCAGA | 2101 | UCUGAAUCUGAAGAGUCAA | 2102 |
| NM_005080_656-674 | CCUGUUGGGCAUUCUGGAC | 2103 | GUCCAGAAUGCCCAACAGG | 2104 |
| NM_005080_719-737 | UGCCAGCCUGGAGGAGCUC | 2105 | GAGCUCCUCCAGGCUGGCA | 2106 |
| NM_005080_720-738 | GCCAGCCUGGAGGAGCUCC | 2107 | GGAGCUCCUCCAGGCUGGC | 2108 |
| NM_005080_721-739 | CCAGCCUGGAGGAGCUCCC | 2109 | GGGAGCUCCUCCAGGCUGG | 2110 |
| NM_005080_782-800 | UUCUCUGUCAGUGGGGACG | 2111 | CGUCCCCACUGACAGAGAA | 2112 |

TABLE 8-continued

XBP-1 human/Rhesus siRNAs

| Oligo Name/<br>Positions on target<br>sequence (5'to 3') | sense (5'-3') | SEQ<br>ID<br>NO: | antisense (5'-3') | SEQ<br>ID<br>NO: |
|---|---|---|---|---|
| NM_005080_867-885 | GUCUUAGAGAUACCCUCUG | 2113 | CAGAGGGUAUCUCUAAGAC | 2114 |
| NM_005080_48-66 | UAUGGUGGUGGUGGCAGCC | 2115 | GGCUGCCACCACCACCAUA | 2116 |
| NM_005080_963-981 | UUCAUUGUCUCAGUGAAGG | 2117 | CCUUCACUGAGACAAUGAA | 2118 |

Gene XBP1
reference transcript NM_005080 (human XBP1 mRNA, FIG. 2)
Notes
19mers found in both human and rhesus

TABLE 9

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_390-408 | AGAAAAUCAGCUUUUACGANN | 2203 | UCGUAAAAGCUGAUUUUCUNN | 2204 |
| NM_005080_1184-1202 | UCCCCAGCUGAUUAGUGUCNN | 2205 | GACACUAAUCAGCUGGGGANN | 2206 |
| NM_005080_1494-1512 | UACUUAUUAUGUAAGGGUCNN | 2207 | GACCCUUACAUAAUAAGUANN | 2208 |
| NM_005080_1463-1481 | UAUCUUAAAAGGGUGGUAGNN | 2209 | CUACCACCCUUUUAAGAUANN | 2210 |
| NM_005080_610-628 | CCAUGGAUUCUGGCGGUAUNN | 2211 | AUACCGCCAGAAUCCAUGGNN | 2212 |
| NM_005080_823-841 | UUAAUGAACUAAUUCGUUUNN | 2213 | AAACGAAUUAGUUCAUUAANN | 2214 |
| NM_005080_1507-1525 | AGGGUCAUUAGACAAAUGUNN | 2215 | ACAUUUGUCUAAUGACCCUNN | 2216 |
| NM_005080_827-845 | UGAACUAAUUCGUUUUGACNN | 2217 | GUCAAAACGAAUUAGUUCANN | 2218 |
| NM_005080_1503-1521 | UGUAAGGGUCAUUAGACAANN | 2219 | UUGUCUAAUGACCCUUACANN | 2220 |
| NM_005080_829-847 | AACUAAUUCGUUUUGACCANN | 2221 | UGGUCAAAACGAAUUAGUUNN | 2222 |
| NM_005080_1783-1801 | UAUUUAAAACUACCCAUGCNN | 2223 | GCAUGGGUAGUUUUAAAUANN | 2224 |
| NM_005080_1183-1201 | UUCCCCAGCUGAUUAGUGUNN | 2225 | ACACUAAUCAGCUGGGGAANN | 2226 |
| NM_005080_1501-1519 | UAUGUAAGGGUCAUUAGACNN | 2227 | GUCUAAUGACCCUUACAUANN | 2228 |
| NM_005080_1504-1522 | GUAAGGGUCAUUAGACAAANN | 2229 | UUUGUCUAAUGACCCUUACNN | 2230 |
| NM_005080_734-752 | GCUCCCAGAGGUCUACCCANN | 2231 | UGGGUAGACCUCUGGGAGCNN | 2232 |
| NM_005080_893-911 | GAGCCAAGCUAAUGUGGUANN | 2233 | UACCACAUUAGCUUGGCUCNN | 2234 |
| NM_005080_1064-1082 | CUGCCUACUGGAUGCUUACNN | 2235 | GUAAGCAUCCAGUAGGCAGNN | 2236 |
| NM_005080_1066-1084 | GCCUACUGGAUGCUUACAGNN | 2237 | CUGUAAGCAUCCAGUAGGCNN | 2238 |
| NM_005080_1136-1154 | GCUUGGUGUAAACCAUUCUNN | 2239 | AGAAUGGUUUACACCAAGCNN | 2240 |
| NM_005080_1137-1155 | CUUGGUGUAAACCAUUCUUNN | 2241 | AAGAAUGGUUUACACCAAGNN | 2242 |
| NM_005080_1182-1200 | UUUCCCCAGCUGAUUAGUGNN | 2243 | CACUAAUCAGCUGGGGAAANN | 2244 |
| NM_005080_1186-1204 | CCCAGCUGAUUAGUGUCUANN | 2245 | UAGACACUAAUCAGCUGGGNN | 2246 |
| NM_005080_1189-1207 | AGCUGAUUAGUGUCUAAGGNN | 2247 | CCUUAGACACUAAUCAGCUNN | 2248 |
| NM_005080_1224-1242 | UGCCCUUUUCCUUGACUAUNN | 2249 | AUAGUCAAGGAAAAGGGCANN | 2250 |
| NM_005080_1229-1247 | UUUUCCUUGACUAUUACACNN | 2251 | GUGUAAUAGUCAAGGAAAANN | 2252 |
| NM_005080_1235-1253 | UUGACUAUUACACUGCCUGNN | 2253 | CAGGCAGUGUAAUAGUCAANN | 2254 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
| --- | --- | --- | --- | --- |
| NM_005080_1236-1254 | UGACUAUUACACUGCCUGGNN | 2255 | CCAGGCAGUGUAAUAGUCANN | 2256 |
| NM_005080_1438-1456 | ACUACAGCUUUUAAGAUUGNN | 2257 | CAAUCUUAAAAGCUGUAGNN | 2258 |
| NM_005080_1441-1459 | ACAGCUUUUAAGAUUGUACNN | 2259 | GUACAAUCUUAAAAGCUGUNN | 2260 |
| NM_005080_1442-1460 | CAGCUUUUAAGAUUGUACUNN | 2261 | AGUACAAUCUUAAAAGCUGNN | 2262 |
| NM_005080_1493-1511 | AUACUUAUUAUGUAAGGGUNN | 2263 | ACCCUUACAUAAUAAGUAUNN | 2264 |
| NM_005080_1502-1520 | AUGUAAGGGUCAUUAGACANN | 2265 | UGUCUAAUGACCCUUACAUNN | 2266 |
| NM_005080_1506-1524 | AAGGGUCAUUAGACAAAUGNN | 2267 | CAUUUGUCUAAUGACCCUUNN | 2268 |
| NM_005080_1594-1612 | UUGCCUCCAGUUUUAGGUCNN | 2269 | GACCUAAAACUGGAGGCAANN | 2270 |
| NM_005080_1790-1808 | AACUACCCAUGCAAUUAAANN | 2271 | UUUAAUUGCAUGGGUAGUNN | 2272 |
| NM_005080_304-322 | ACUGCCAGAGAUCGAAAGANN | 2273 | UCUUUCGAUCUCUGGCAGUNN | 2274 |
| NM_005080_305-323 | CUGCCAGAGAUCGAAAGAANN | 2275 | UUCUUUCGAUCUCUGGCAGNN | 2276 |
| NM_005080_395-413 | AUCAGCUUUUACGAGAGAANN | 2277 | UUCUCUCGUAAAAGCUGAUNN | 2278 |
| NM_005080_609-627 | CCCAUGGAUUCUGGCGGUANN | 2279 | UACCGCCAGAAUCCAUGGGNN | 2280 |
| NM_005080_611-629 | CAUGGAUUCUGGCGGUAUUNN | 2281 | AAUACCGCCAGAAUCCAUGNN | 2282 |
| NM_005080_617-635 | UUCUGGCGGUAUUGACUCUNN | 2283 | AGAGUCAAUACCGCCAGAANN | 2284 |
| NM_005080_621-639 | GGCGGUAUUGACUCUUCAGNN | 2285 | CUGAAGAGUCAAUACCGCCNN | 2286 |
| NM_005080_641-659 | UUCAGAGUCUGAUAUCCUGNN | 2287 | CAGGAUAUCAGACUCUGAANN | 2288 |
| NM_005080_648-666 | UCUGAUAUCCUGUUGGGCANN | 2289 | UGCCCAACAGGAUAUCAGANN | 2290 |
| NM_005080_651-669 | GAUAUCCUGUUGGGCAUUCNN | 2291 | GAAUGCCCAACAGGAUAUCNN | 2292 |
| NM_005080_735-753 | CUCCCAGAGGUCUACCCAGNN | 2293 | CUGGGUAGACCUCUGGGAGNN | 2294 |
| NM_005080_753-771 | GAAGGACCCAGUUCCUUACNN | 2295 | GUAAGGAACUGGGUCCUUCNN | 2296 |
| NM_005080_794-812 | GGGGACGUCAUCAGCCAAGNN | 2297 | CUUGGCUGAUGACGUCCCNN | 2298 |
| NM_005080_826-844 | AUGAACUAAUUCGUUUUGANN | 2299 | UCAAAACGAAUUAGUUCAUNN | 2300 |
| NM_005080_836-854 | UCGUUUUGACCACAUAUAUNN | 2301 | AUAUAUGUGGUCAAAACGANN | 2302 |
| NM_005080_840-858 | UUUGACCACAUAUAUACCANN | 2303 | UGGUAUAUAUGUGGUCAAANN | 2304 |
| NM_005080_841-859 | UUGACCACAUAUAUACCAANN | 2305 | UUGGUAUAUAUGUGGUCANN | 2306 |
| NM_005080_847-865 | ACAUAUAUACCAAGCCCCUNN | 2307 | AGGGGCUUGGUAUAUAUGUNN | 2308 |
| NM_005080_894-912 | AGCCAAGCUAAUGUGGUAGNN | 2309 | CUACCACAUUAGCUUGGCUNN | 2310 |
| NM_005080_895-913 | GCCAAGCUAAUGUGGUAGUNN | 2311 | ACUACCACAUUAGCUUGGCNN | 2312 |
| NM_005080_896-914 | CCAAGCUAAUGUGGUAGUGNN | 2313 | CACUACCACAUUAGCUUGGNN | 2314 |
| NM_005080_899-917 | AGCUAAUGUGGUAGUGAANN | 2315 | UUUCACUACCACAUUAGCUNN | 2316 |
| NM_005080_908-926 | GGUAGUGAAAUCGAGGAANN | 2317 | UUCCUCGAUUUCACUACCNN | 2318 |
| NM_005080_917-935 | AAUCGAGGAAGCACCUCUCNN | 2319 | GAGAGGUGCUUCCUCGAUUNN | 2320 |
| NM_005080_937-955 | GCCCCUCAGAGAAUGAUCNN | 2321 | UGAUCAUUCUCUGAGGGGCNN | 2322 |
| NM_005080_950-968 | UGAUCACCCUGAAUUCAUUNN | 2323 | AAUGAAUUCAGGGUGAUCANN | 2324 |
| NM_005080_1185-1203 | CCCCAGCUGAUUAGUGUCUNN | 2325 | AGACACUAAUCAGCUGGGGNN | 2326 |
| NM_005080_1187-1205 | CCAGCUGAUUAGUGUCUAANN | 2327 | UUAGACACUAAUCAGCUGGNN | 2328 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_1153-1171 | CUUGGGAGGACACUUUUGCNN | 2329 | GCAAAAGUGUCCUCCCAAGNN | 2330 |
| NM_005080_1787-1805 | UAAAACUACCCAUGCAAUUNN | 2331 | AAUUGCAUGGGUAGUUUUANN | 2332 |
| NM_005080_606-624 | CUCCCCAUGGAUUCUGGCGNN | 2333 | CGCCAGAAUCCAUGGGGAGNN | 2334 |
| NM_005080_1019-1037 | UAUCUCAAAUCUGCUUUCANN | 2335 | UGAAAGCAGAUUUGAGAUANN | 2336 |
| NM_005080_1072-1090 | UGGAUGCUUACAGUGACUGNN | 2337 | CAGUCACUGUAAGCAUCCANN | 2338 |
| NM_005080_1228-1246 | CUUUUCCUUGACUAUUACANN | 2339 | UGUAAUAGUCAAGGAAAAGNN | 2340 |
| NM_005080_1461-1479 | UUUAUCUUAAAAGGGUGGUNN | 2341 | ACCACCCUUUUAAGAUAAANN | 2342 |
| NM_005080_1495-1513 | ACUUAUUAUGUAAGGGUCANN | 2343 | UGACCCUUACAUAAUAAGUNN | 2344 |
| NM_005080_1496-1514 | CUUAUUAUGUAAGGGUCAUNN | 2345 | AUGACCCUUACAUAAUAAGNN | 2346 |
| NM_005080_1500-1518 | UUAUGUAAGGGUCAUUAGANN | 2347 | UCUAAUGACCCUUACAUAANN | 2348 |
| NM_005080_1644-1662 | CCUGCUGAGGGGGCUCUUUNN | 2349 | AAAGAGCCCCCUCAGCAGGNN | 2350 |
| NM_005080_1708-1726 | AUAGAAAUUUACUAUGUAANN | 2351 | UUACAUAGUAAAUUUCUAUNN | 2352 |
| NM_005080_302-320 | AGACUGCCAGAGAUCGAAANN | 2353 | UUUCGAUCUCUGGCAGUCUNN | 2354 |
| NM_005080_607-625 | UCCCCAUGGAUUCUGGCGGNN | 2355 | CCGCCAGAAUCCAUGGGGANN | 2356 |
| NM_005080_824-842 | UAAUGAACUAAUUCGUUUUNN | 2357 | AAAACGAAUUAGUUCAUUANN | 2358 |
| NM_005080_953-971 | UCACCCUGAAUUCAUUGUCNN | 2359 | GACAAUGAAUUCAGGGUGANN | 2360 |
| NM_005080_1011-1029 | GAGCUGGGUAUCUCAAAUCNN | 2361 | GAUUUGAGAUACCCAGCUCNN | 2362 |
| NM_005080_1230-1248 | UUUCCUUGACUAUUACACUNN | 2363 | AGUGUAAUAGUCAAGGAAANN | 2364 |
| NM_005080_1231-1249 | UUCCUUGACUAUUACACUGNN | 2365 | CAGUGUAAUAGUCAAGGAANN | 2366 |
| NM_005080_1290-1308 | AAAGCCAAAAUAGAGAGUANN | 2367 | UACUCUCUAUUUUGGCUUUNN | 2368 |
| NM_005080_1331-1349 | AUUUGUUCAGAUCUCAUAGNN | 2369 | CUAUGAGAUCUGAACAAAUNN | 2370 |
| NM_005080_1460-1478 | UUUUAUCUUAAAAGGGUGGNN | 2371 | CCACCCUUUUAAGAUAAAANN | 2372 |
| NM_005080_1670-1688 | GUAUACUUCAAGUAAGAUCNN | 2373 | GAUCUUACUUGAAGUAUACNN | 2374 |
| NM_005080_1671-1689 | UAUACUUCAAGUAAGAUCANN | 2375 | UGAUCUUACUUGAAGUAUANN | 2376 |
| NM_005080_1735-1753 | UGGAAUUUUUCCUGCUAGNN | 2377 | CUAGCAGGAAAAAUUCCANN | 2378 |
| NM_005080_1744-1762 | UUCCUGCUAGUGUAGCUUCNN | 2379 | GAAGCUACACUAGCAGGAANN | 2380 |
| NM_005080_1796-1814 | CCAUGCAAUUAAAAGGUACNN | 2381 | GUACCUUUUAAUUGCAUGGNN | 2382 |
| NM_005080_343-361 | GAACAGCAAGUGGUAGAUUNN | 2383 | AAUCUACCACUUGCUGUUCNN | 2384 |
| NM_005080_374-392 | ACCAAAAACUUUUGCUAGANN | 2385 | UCUAGCAAAAGUUUUUGGUNN | 2386 |
| NM_005080_375-393 | CCAAAAACUUUUGCUAGAANN | 2387 | UUCUAGCAAAAGUUUUUGGNN | 2388 |
| NM_005080_608-626 | CCCCAUGGAUUCUGGCGGNN | 2389 | ACCGCCAGAAUCCAUGGGGNN | 2390 |
| NM_005080_652-670 | AUACCUGUUGGGCAUUCUNN | 2391 | AGAAUGCCCAACAGGAUAUNN | 2392 |
| NM_005080_686-704 | AGUCAUGUUCUUCAAAUGCNN | 2393 | GCAUUUGAAGAACAUGACUNN | 2394 |
| NM_005080_909-927 | GUAGUGAAAAUCGAGGAAGNN | 2395 | CUUCCUCGAUUUUCACUACNN | 2396 |
| NM_005080_951-969 | GAUCACCCUGAAUUCAUUGNN | 2397 | CAAUGAAUUCAGGGUGAUCNN | 2398 |
| NM_005080_952-970 | AUCACCCUGAAUUCAUUGUNN | 2399 | ACAAUGAAUUCAGGGUGAUNN | 2400 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_825-843 | AAUGAACUAAUUCGUUUUGNN | 2401 | CAAAACGAAUUAGUUCAUUNN | 2402 |
| NM_005080_1194-1212 | AUUAGUGUCUAAGGAAUGANN | 2403 | UCAUUCCUUAGACACUAAUNN | 2404 |
| NM_005080_831-849 | CUAAUUCGUUUUGACCACANN | 2405 | UGUGGUCAAAACGAAUUAGNN | 2406 |
| NM_005080_835-853 | UUCGUUUUGACCACAUAUANN | 2407 | UAUAUGUGGUCAAAACGAANN | 2408 |
| NM_005080_869-887 | CUUAGAGAUACCCUCUGAGNN | 2409 | CUCAGAGGGUAUCUCUAAGNN | 2410 |
| NM_005080_1246-1264 | ACUGCCUGGAGGAUAGCAGNN | 2411 | CUGCUAUCCUCCAGGCAGUNN | 2412 |
| NM_005080_1453-1471 | AUUGUACUUUUAUCUUAAANN | 2413 | UUUAAGAUAAAAGUACAAUNN | 2414 |
| NM_005080_1512-1530 | CAUUAGACAAAUGUCUUGANN | 2415 | UCAAGACAUUUGUCUAAUGNN | 2416 |
| NM_005080_1546-1564 | UAUGAAUGGUUCUUUAUCANN | 2417 | UGAUAAAGAACCAUUCAUANN | 2418 |
| NM_005080_1789-1807 | AAACUACCCAUGCAAUUAANN | 2419 | UUAAUUGCAUGGGUAGUUUNN | 2420 |
| NM_005080_325-343 | GCUCGAAUGAGUGAGCUGGNN | 2421 | CCAGCUCACUCAUUCGAGCNN | 2422 |
| NM_005080_393-411 | AAAUCAGCUUUUACGAGAGNN | 2423 | CUCUCGUAAAAGCUGAUUUNN | 2424 |
| NM_005080_788-806 | GUCAGUGGGGACGUCAUCNN | 2425 | UGAUGACGUCCCCACUGACNN | 2426 |
| NM_005080_821-839 | CAUUAAUGAACUAAUUCGUNN | 2427 | ACGAAUUAGUUCAUUAAUGNN | 2428 |
| NM_005080_1514-1532 | UUAGACAAAUGUCUUGAAGNN | 2429 | CUUCAAGACAUUUGUCUAANN | 2430 |
| NM_005080_1797-1815 | CAUGCAAUUAAAAGGUACANN | 2431 | UGUACCUUUUAAUUGCAUGNN | 2432 |
| NM_005080_833-851 | AAUUCGUUUUGACCACAUANN | 2433 | UAUGUGGUCAAAACGAAUUNN | 2434 |
| NM_005080_1509-1527 | GGUCAUUAGACAAAUGUCUNN | 2435 | AGACAUUUGUCUAAUGACCNN | 2436 |
| NM_005080_1802-1820 | AAUUAAAAGGUACAAUGCANN | 2437 | UGCAUUGUACCUUUUAAUUNN | 2438 |
| NM_005080_391-409 | GAAAAUCAGCUUUUACGAGNN | 2439 | CUCGUAAAAGCUGAUUUUCNN | 2440 |
| NM_005080_843-861 | GACCACAUAUAUACCAAGCNN | 2441 | GCUUGGUAUAUAUGUGGUCNN | 2442 |
| NM_005080_1508-1526 | GGGUCAUUAGACAAAUGUCNN | 2443 | GACAUUUGUCUAAUGACCCNN | 2444 |
| NM_005080_1754-1772 | UGUAGCUUCUGAAAGGUGCNN | 2445 | GCACCUUUCAGAAGCUACANN | 2446 |
| NM_005080_430-448 | GUUGAGAACCAGGAGUUAANN | 2447 | UUAACUCCUGGUUCUCAACNN | 2448 |
| NM_005080_437-455 | ACCAGGAGUUAAGACAGCGNN | 2449 | CGCUGUCUUAACUCCUGGUNN | 2450 |
| NM_005080_1465-1483 | UCUUAAAAGGGUGGUAGUUNN | 2451 | AACUACCACCCUUUUAAGANN | 2452 |
| NM_005080_1742-1760 | UUUUCCUGCUAGUGUAGCUNN | 2453 | AGCUACACUAGCAGGAAAANN | 2454 |
| NM_005080_438-456 | CCAGGAGUUAAGACAGCGCNN | 2455 | GCGCUGUCUUAACUCCUGGNN | 2456 |
| NM_005080_1060-1078 | CUUCCUGCCUACUGGAUGCNN | 2457 | GCAUCCAGUAGGCAGGAAGNN | 2458 |
| NM_005080_1067-1085 | CCUACUGGAUGCUUACAGUNN | 2459 | ACUGUAAGCAUCCAGUAGGNN | 2460 |
| NM_005080_1197-1215 | AGUGUCUAAGGAAUGAUCCNN | 2461 | GGAUCAUUCCUUAGACACUNN | 2462 |
| NM_005080_1198-1216 | GUGUCUAAGGAAUGAUCCANN | 2463 | UGGAUCAUUCCUUAGACACNN | 2464 |
| NM_005080_1424-1442 | UACUAUAAUUGAGAACUACNN | 2465 | GUAGUUCUCAAUUAUAGUANN | 2466 |
| NM_005080_1464-1482 | AUCUUAAAAGGGUGGUAGUNN | 2467 | ACUACCACCCUUUUAAGAUNN | 2468 |
| NM_005080_616-634 | AUUCUGGCGGUAUUGACUCNN | 2469 | GAGUCAAUACCGCCAGAAUNN | 2470 |
| NM_005080_757-775 | GACCCAGUUCCUUACCAGCNN | 2471 | GCUGGUAAGGAACUGGGUCNN | 2472 |
| NM_005080_785-803 | UCUGUCAGUGGGGACGUCANN | 2473 | UGACGUCCCCACUGACAGANN | 2474 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
| --- | --- | --- | --- | --- |
| NM_005080_819-837 | GCCAUUAAUGAACUAAUUCNN | 2475 | GAAUUAGUUCAUUAAUGGCNN | 2476 |
| NM_005080_842-860 | UGACCACAUAUAUACCAAGNN | 2477 | CUUGGUAUAUAUGUGGUCANN | 2478 |
| NM_005080_845-863 | CCACAUAUAUACCAAGCCCNN | 2479 | GGGCUUGGUAUAUAUGUGGNN | 2480 |
| NM_005080_1013-1031 | GCUGGGUAUCUCAAAUCUGNN | 2481 | CAGAUUUGAGAUACCCAGCNN | 2482 |
| NM_005080_1431-1449 | AUUGAGAACUACAGCUUUUNN | 2483 | AAAAGCUGUAGUUCUCAAUNN | 2484 |
| NM_005080_1673-1691 | UACUUCAAGUAAGAUCAAGNN | 2485 | CUUGAUCUUACUUGAAGUANN | 2486 |
| NM_005080_283-301 | AAAAACAGAGUAGCAGCUCNN | 2487 | GAGCUGCUACUCUGUUUUUNN | 2488 |
| NM_005080_838-856 | GUUUUGACCACAUAUAUACNN | 2489 | GUAUAUAUGUGGUCAAAACNN | 2490 |
| NM_005080_279-297 | ACUGAAAAACAGAGUAGCANN | 2491 | UGCUACUCUGUUUUUCAGUNN | 2492 |
| NM_005080_633-651 | UCUUCAGAUUCAGAGUCUGNN | 2493 | CAGACUCUGAAUCUGAAGANN | 2494 |
| NM_005080_1024-1042 | CAAAUCUGCUUUCAUCCAGNN | 2495 | CUGGAUGAAAGCAGAUUUGNN | 2496 |
| NM_005080_1147-1165 | ACCAUUCUUGGGAGGACACNN | 2497 | GUGUCCUCCCAAGAAUGGUNN | 2498 |
| NM_005080_1154-1172 | UUGGGAGGACACUUUUGCCNN | 2499 | GGCAAAAGUGUCCUCCCAANN | 2500 |
| NM_005080_1188-1206 | CAGCUGAUUAGUGUCUAAGNN | 2501 | CUUAGACACUAAUCAGCUGNN | 2502 |
| NM_005080_1192-1210 | UGAUUAGUGUCUAAGGAAUNN | 2503 | AUUCCUUAGACACUAAUCANN | 2504 |
| NM_005080_1195-1213 | UUAGUGUCUAAGGAAUGAUNN | 2505 | AUCAUUCCUUAGACACUAANN | 2506 |
| NM_005080_1238-1256 | ACUAUUACACUGCCUGGAGNN | 2507 | CUCCAGGCAGUGUAAUAGUNN | 2508 |
| NM_005080_1548-1566 | UGAAUGGUUCUUUAUCAUUNN | 2509 | AAUGAUAAAGAACCAUUCANN | 2510 |
| NM_005080_1549-1567 | GAAUGGUUCUUUAUCAUUUNN | 2511 | AAAUGAUAAAGAACCAUUCNN | 2512 |
| NM_005080_1677-1695 | UCAAGUAAGAUCAAGAAUCNN | 2513 | GAUUCUUGAUCUUACUUGANN | 2514 |
| NM_005080_1707-1725 | UAUAGAAAUUUACUAUGUANN | 2515 | UACAUAGUAAAUUUCUAUANN | 2516 |
| NM_005080_1713-1731 | AAUUUACUAUGUAAAUGCUNN | 2517 | AGCAUUUACAUAGUAAAUUNN | 2518 |
| NM_005080_1786-1804 | UUAAAACUACCCAUGCAAUNN | 2519 | AUUGCAUGGGUAGUUUUAANN | 2520 |
| NM_005080_210-228 | GCUGCCCCAGGCGCGCAAGNN | 2521 | CUUGCGCGCCUGGGGCAGCNN | 2522 |
| NM_005080_278-296 | AACUGAAAAACAGAGUAGCNN | 2523 | GCUACUCUGUUUUUCAGUUNN | 2524 |
| NM_005080_284-302 | AAAACAGAGUAGCAGCUCANN | 2525 | UGAGCUGCUACUCUGUUUUNN | 2526 |
| NM_005080_290-308 | GAGUAGCAGCUCAGACUGCNN | 2527 | GCAGUCUGAGCUGCUACUCNN | 2528 |
| NM_005080_342-360 | GGAACAGCAAGUGGUAGAUNN | 2529 | AUCUACCACUUGCUGUUCCNN | 2530 |
| NM_005080_431-449 | UUGAGAACCAGGAGUUAAGNN | 2531 | CUUAACUCCUGGUUCUCAANN | 2532 |
| NM_005080_576-594 | GCAGGCCCAGUUGUCACCCNN | 2533 | GGGUGACAACUGGGCCUGCNN | 2534 |
| NM_005080_602-620 | ACAUCUCCCCAUGGAUUCUNN | 2535 | AGAAUCCAUGGGGAGAUGUNN | 2536 |
| NM_005080_618-636 | UCUGGCGGUAUUGACUCUUNN | 2537 | AAGAGUCAAUACCGCCAGANN | 2538 |
| NM_005080_678-696 | UUGGACCCAGUCAUGUUCUNN | 2539 | AGAACAUGACUGGGUCCAANN | 2540 |
| NM_005080_796-814 | GGACGUCAUCAGCCAAGCUNN | 2541 | AGCUUGGCUGAUGACGUCCNN | 2542 |
| NM_005080_940-958 | CCUCAGAGAAUGAUCACCCNN | 2543 | GGGUGAUCAUUCUCUGAGGNN | 2544 |
| NM_005080_954-972 | CACCCUGAAUUCAUUGUCUNN | 2545 | AGACAAUGAAUUCAGGGUGNN | 2546 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_977-995 | GAAGGAAGAACCUGUAGAANN | 2547 | UUCUACAGGUUCUUCCUUCNN | 2548 |
| NM_005080_1018-1036 | GUAUCUCAAAUCUGCUUUCNN | 2549 | GAAAGCAGAUUUGAGAUACNN | 2550 |
| NM_005080_1026-1044 | AAUCUGCUUUCAUCCAGCCNN | 2551 | GGCUGGAUGAAAGCAGAUUNN | 2552 |
| NM_005080_1138-1156 | UUGGUGUAAACCAUUCUUGNN | 2553 | CAAGAAUGGUUUACACCAANN | 2554 |
| NM_005080_1141-1159 | GUGUAAACCAUUCUUGGGANN | 2555 | UCCCAAGAAUGGUUUACACNN | 2556 |
| NM_005080_1142-1160 | UGUAAACCAUUCUUGGGAGNN | 2557 | CUCCCAAGAAUGGUUUACANN | 2558 |
| NM_005080_1155-1173 | UGGGAGGACACUUUUGCCANN | 2559 | UGGCAAAAGUGUCCUCCCANN | 2560 |
| NM_005080_1158-1176 | GAGGACACUUUUGCCAAUGNN | 2561 | CAUUGGCAAAAGUGUCCUCNN | 2562 |
| NM_005080_1193-1211 | GAUUAGUGUCUAAGGAAUGNN | 2563 | CAUUCCUUAGACACUAAUCNN | 2564 |
| NM_005080_1196-1214 | UAGUGUCUAAGGAAUGAUCNN | 2565 | GAUCAUUCCUUAGACACUANN | 2566 |
| NM_005080_1219-1237 | ACUGUUGCCCUUUUCCUUGNN | 2567 | CAAGGAAAAGGGCAACAGUNN | 2568 |
| NM_005080_107-125 | UGUCGGGGCAGCCCGCCUCNN | 2569 | GAGGCGGGCUGCCCCGACANN | 2570 |
| NM_005080_108-126 | GUCGGGGCAGCCCGCCUCCNN | 2571 | GGAGGCGGGCUGCCCCGACNN | 2572 |
| NM_005080_1505-1523 | UAAGGGUCAUUAGACAAAUNN | 2573 | AUUUGUCUAAUGACCCUUANN | 2574 |
| NM_005080_1567-1585 | UCUCUUCCCCCUUUUUGGCNN | 2575 | GCCAAAAAGGGGGAAGAGANN | 2576 |
| NM_005080_1672-1690 | AUACUUCAAGUAAGAUCAANN | 2577 | UUGAUCUUACUUGAAGUAUNN | 2578 |
| NM_005080_1678-1696 | CAAGUAAGAUCAAGAAUCUNN | 2579 | AGAUUCUUGAUCUUACUUGNN | 2580 |
| NM_005080_1778-1796 | CCAUUUAUUUAAAACUACCNN | 2581 | GGUAGUUUUAAAUAAAUGGNN | 2582 |
| NM_005080_1779-1797 | CAUUUAUUUAAAACUACCCNN | 2583 | GGGUAGUUUUAAAUAAAUGNN | 2584 |
| NM_005080_280-298 | CUGAAAAACAGAGUAGCAGNN | 2585 | CUGCUACUCUGUUUUUCAGNN | 2586 |
| NM_005080_282-300 | GAAAAACAGAGUAGCAGCUNN | 2587 | AGCUGCUACUCUGUUUUUCNN | 2588 |
| NM_005080_288-306 | CAGAGUAGCAGCUCAGACUNN | 2589 | AGUCUGAGCUGCUACUCUGNN | 2590 |
| NM_005080_291-309 | AGUAGCAGCUCAGACUGCCNN | 2591 | GGCAGUCUGAGCUGCUACUNN | 2592 |
| NM_005080_347-365 | AGCAAGUGGUAGAUUUAGANN | 2593 | UCUAAAUCUACCACUUGCUNN | 2594 |
| NM_005080_397-415 | CAGCUUUUACGAGAGAAAANN | 2595 | UUUUCUCUCGUAAAAGCUGNN | 2596 |
| NM_005080_398-416 | AGCUUUUACGAGAGAAAACNN | 2597 | GUUUUCUCUCGUAAAAGCUNN | 2598 |
| NM_005080_399-417 | GCUUUUACGAGAGAAAACUNN | 2599 | AGUUUUCUCUCGUAAAAGCNN | 2600 |
| NM_005080_512-530 | UGAGGCCAGUGGCCGGGUCNN | 2601 | GACCCGGCCACUGGCCUCANN | 2602 |
| NM_005080_517-535 | CCAGUGGCCGGGUCUGCUGNN | 2603 | CAGCAGACCCGGCCACUGGNN | 2604 |
| NM_005080_596-614 | UCCAGAACAUCUCCCCAUGNN | 2605 | CAUGGGGAGAUGUUCUGGANN | 2606 |
| NM_005080_598-616 | CAGAACAUCUCCCCAUGGANN | 2607 | UCCAUGGGGAGAUGUUCUGNN | 2608 |
| NM_005080_601-619 | AACAUCUCCCCAUGGAUUCNN | 2609 | GAAUCCAUGGGGAGAUGUUNN | 2610 |
| NM_005080_605-623 | UCUCCCCAUGGAUUCUGGCNN | 2611 | GCCAGAAUCCAUGGGGAGANN | 2612 |
| NM_005080_661-679 | UGGGCAUUCUGGACAACUUNN | 2613 | AAGUUGUCCAGAAUGCCCANN | 2614 |
| NM_005080_688-706 | UCAUGUUCUUCAAAUGCCCNN | 2615 | GGGCAUUUGAAGAACAUGANN | 2616 |
| NM_005080_691-709 | UGUUCUUCAAAUGCCCUUCNN | 2617 | GAAGGGCAUUUGAAGAACANN | 2618 |
| NM_005080_828-846 | GAACUAAUUCGUUUUGACCNN | 2619 | GGUCAAAACGAAUUAGUUCNN | 2620 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_830-848 | ACUAAUUCGUUUUGACCACNN | 2621 | GUGGUCAAAACGAAUUAGUNN | 2622 |
| NM_005080_834-852 | AUUCGUUUUGACCACAUAUNN | 2623 | AUAUGUGGUCAAAACGAAUNN | 2624 |
| NM_005080_846-864 | CACAUAUAUACCAAGCCCCNN | 2625 | GGGGCUUGGUAUAUAUGUGNN | 2626 |
| NM_005080_870-888 | UUAGAGAUACCCUCUGAGANN | 2627 | UCUCAGAGGGUAUCUCUAANN | 2628 |
| NM_005080_891-909 | GAGAGCCAAGCUAAUGUGGNN | 2629 | CCACAUUAGCUUGGCUCUCNN | 2630 |
| NM_005080_900-918 | GCUAAUGUGGUAGUGAAAANN | 2631 | UUUUCACUACCACAUUAGCNN | 2632 |
| NM_005080_911-929 | AGUGAAAAUCGAGGAAGCANN | 2633 | UGCUUCCUCGAUUUUCACUNN | 2634 |
| NM_005080_912-930 | GUGAAAAUCGAGGAAGCACNN | 2635 | GUGCUUCCUCGAUUUUCACNN | 2636 |
| NM_005080_979-997 | AGGAAGAACCUGUAGAAGANN | 2637 | UCUUCUACAGGUUCUUCCUNN | 2638 |
| NM_005080_1366-1384 | GUCUUUUGACAUCCAGCAGNN | 2639 | CUGCUGGAUGUCAAAAGACNN | 2640 |
| NM_005080_150-168 | GGCCCUGCCGCUCAUGGUGNN | 2641 | CACCAUGAGCGGCAGGGCCNN | 2642 |
| NM_005080_1437-1455 | AACUACAGCUUUUAAGAUUNN | 2643 | AAUCUUAAAAGCUGUAGUUNN | 2644 |
| NM_005080_482-500 | AAGAGGAGGCGGAAGCCAANN | 2645 | TTGGCTTCCGCCTCCTCTTNN | 2646 |
| NM_005080_580-598 | GCCCAGUUGUCACCCCUCCNN | 2647 | GGAGGGGUGACAACUGGGCNN | 2648 |
| NM_005080_613-631 | UGGAUUCUGGCGGUAUUGANN | 2649 | UCAAUACCGCCAGAAUCCANN | 2650 |
| NM_005080_1065-1083 | UGCCUACUGGAUGCUUACANN | 2651 | UGUAAGCAUCCAGUAGGCANN | 2652 |
| NM_005080_614-632 | GGAUUCUGGCGGUAUUGACNN | 2653 | GUCAAUACCGCCAGAAUCCNN | 2654 |
| NM_005080_640-658 | AUUCAGAGUCUGAUAUCCUNN | 2655 | AGGAUAUCAGACUCUGAAUNN | 2656 |
| NM_005080_1014-1032 | CUGGGUAUCUCAAAUCUGCNN | 2657 | GCAGAUUUGAGAUACCCAGNN | 2658 |
| NM_005080_1015-1033 | UGGGUAUCUCAAAUCUGCUNN | 2659 | AGCAGAUUUGAGAUACCCANN | 2660 |
| NM_005080_1146-1164 | AACCAUUCUUGGGAGGACANN | 2661 | UGUCCUCCCAAGAAUGGUUNN | 2662 |
| NM_005080_1232-1250 | UCCUUGACUAUUACACUGCNN | 2663 | GCAGUGUAAUAGUCAAGGANN | 2664 |
| NM_005080_1234-1252 | CUUGACUAUUACACUGCCUNN | 2665 | AGGCAGUGUAAUAGUCAAGNN | 2666 |
| NM_005080_1237-1255 | GACUAUUACACUGCCUGGANN | 2667 | UCCAGGCAGUGUAAUAGUCNN | 2668 |
| NM_005080_1443-1461 | AGCUUUUAAGAUUGUACUUNN | 2669 | AAGUACAAUCUUAAAAGCUNN | 2670 |
| NM_005080_1462-1480 | UUAUCUUAAAAGGGUGGUANN | 2671 | UACCACCCUUUUAAGAUAANN | 2672 |
| NM_005080_1510-1528 | GUCAUUAGACAAAUGUCUUNN | 2673 | AAGACAUUUGUCUAAUGACNN | 2674 |
| NM_005080_1591-1609 | GGCUUGCCUCCAGUUUUAGNN | 2675 | CUAAAACUGGAGGCAAGCCNN | 2676 |
| NM_005080_1615-1633 | UUAGUUUGCUUCUGUAAGCNN | 2677 | GCUUACAGAAGCAAACUAANN | 2678 |
| NM_005080_1716-1734 | UUACUAUGUAAAUGCUUGANN | 2679 | UCAAGCAUUUACAUAGUAANN | 2680 |
| NM_005080_1718-1736 | ACUAUGUAAAUGCUUGAUGNN | 2681 | CAUCAAGCAUUUACAUAGUNN | 2682 |
| NM_005080_1725-1743 | AAAUGCUUGAUGGAAUUUUNN | 2683 | AAAAUUCCAUCAAGCAUUUNN | 2684 |
| NM_005080_1748-1766 | UGCUAGUGUAGCUUCUGAANN | 2685 | UUCAGAAGCUACACUAGCANN | 2686 |
| NM_005080_1780-1798 | AUUUAUUUAAAACUACCCANN | 2687 | UGGGUAGUUUUAAAUAAAUNN | 2688 |
| NM_005080_1794-1812 | ACCCAUGCAAUUAAAAGGUNN | 2689 | ACCUUUUAAUUGCAUGGGUNN | 2690 |
| NM_005080_156-174 | GCCGCUCAUGGUGCCAGCCNN | 2691 | GGCUGGCACCAUGAGCGGCNN | 2692 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_299-317 | CUCAGACUGCCAGAGAUCGNN | 2693 | CGAUCUCUGGCAGUCUGAGNN | 2694 |
| NM_005080_344-362 | AACAGCAAGUGGUAGAUUUNN | 2695 | AAAUCUACCACUUGCUGUUNN | 2696 |
| NM_005080_371-389 | AGAACCAAAACUUUUGCUNN | 2697 | AGCAAAAGUUUUGGUUCUNN | 2698 |
| NM_005080_373-391 | AACCAAAACUUUUGCUAGNN | 2699 | CUAGCAAAAGUUUUGGUUNN | 2700 |
| NM_005080_524-542 | CCGGGUCUGCUGAGUCCGCNN | 2701 | GCGGACUCAGCAGACCCGGNN | 2702 |
| NM_005080_525-543 | CGGGUCUGCUGAGUCCGCANN | 2703 | UGCGGACUCAGCAGACCCGNN | 2704 |
| NM_005080_612-630 | AUGGAUUCUGGCGGUAUUGNN | 2705 | CAAUACCGCCAGAAUCCAUNN | 2706 |
| NM_005080_615-633 | GAUUCUGGCGGUAUUGACUNN | 2707 | AGUCAAUACCGCCAGAAUCNN | 2708 |
| NM_005080_645-663 | GAGUCUGAUAUCCUGUUGGNN | 2709 | CCAACAGGAUAUCAGACUCNN | 2710 |
| NM_005080_792-810 | GUGGGGACGUCAUCAGCCANN | 2711 | UGGCUGAUGACGUCCCCACNN | 2712 |
| NM_005080_905-923 | UGGGUAGUGAAAAUCGAGNN | 2713 | CUCGAUUUUCACUACCACANN | 2714 |
| NM_005080_976-994 | UGAAGGAAGAACCUGUAGANN | 2715 | UCUACAGGUUCUUCCUUCANN | 2716 |
| NM_005080_1244-1262 | ACACUGCCUGGAGGAUAGCNN | 2717 | GCUAUCCUCCAGGCAGUGUNN | 2718 |
| NM_005080_1791-1809 | ACUACCCAUGCAAUUAAAANN | 2719 | UUUUAAUUGCAUGGGUAGUNN | 2720 |
| NM_005080_755-773 | AGGACCCAGUUCCUUACCANN | 2721 | UGGUAAGGAACUGGGUCCUNN | 2722 |
| NM_005080_799-817 | CGUCAUCAGCCAAGCUGGANN | 2723 | UCCAGCUUGGCUGAUGACGNN | 2724 |
| NM_005080_832-850 | UAAUUCGUUUUGACCACAUNN | 2725 | AUGUGGUCAAAACGAAUUANN | 2726 |
| NM_005080_839-857 | UUUUGACCACAUAUAUACCNN | 2727 | GGUAUAUAUGUGGUCAAAANN | 2728 |
| NM_005080_100-118 | CUGCUUCUGUCGGGCAGCNN | 2729 | GCUGCCCGACAGAAGCAGNN | 2730 |
| NM_005080_281-299 | UGAAAAACAGAGUAGCAGCNN | 2731 | GCUGCUACUCUGUUUUUCANN | 2732 |
| NM_005080_822-840 | AUUAAUGAACUAAUUCGUUNN | 2733 | AACGAAUUAGUUCAUUAAUNN | 2734 |
| NM_005080_1152-1170 | UCUUGGGAGGACACUUUUGNN | 2735 | CAAAAGUGUCCUCCCAAGANN | 2736 |
| NM_005080_1191-1209 | CUGAUUAGUGUCUAAGGAANN | 2737 | UUCCUUAGACACUAAUCAGNN | 2738 |
| NM_005080_1225-1243 | GCCCUUUUCCUUGACUAUUNN | 2739 | AAUAGUCAAGGAAAAGGGCNN | 2740 |
| NM_005080_1227-1245 | CCUUUUCCUUGACUAUUACNN | 2741 | GUAAUAGUCAAGGAAAAGGNN | 2742 |
| NM_005080_1239-1257 | CUAUUACACUGCCUGGAGGNN | 2743 | CCUCCAGGCAGUGUAAUAGNN | 2744 |
| NM_005080_1430-1448 | AAUUGAGAACUACAGCUUUNN | 2745 | AAAGCUGUAGUUCUCAAUUNN | 2746 |
| NM_005080_1499-1517 | AUUAUGUAAGGGUCAUUAGNN | 2747 | CUAAUGACCCUUACAUAAUNN | 2748 |
| NM_005080_1553-1571 | GGUUCUUUAUCAUUUCUCUNN | 2749 | AGAGAAAUGAUAAAGAACCNN | 2750 |
| NM_005080_1585-1603 | CAUCCUGGCUUGCCUCCAGNN | 2751 | CUGGAGGCAAGCCAGGAUGNN | 2752 |
| NM_005080_1592-1610 | GCUUGCCUCCAGUUUUAGGNN | 2753 | CCUAAAACUGGAGGCAAGCNN | 2754 |
| NM_005080_1743-1761 | UUUCCUGCUAGUGUAGCUUNN | 2755 | AAGCUACACUAGCAGGAAANN | 2756 |
| NM_005080_154-172 | CUGCCGCUCAUGGUGCCAGNN | 2757 | CUGGCACCAUGAGCGGCAGNN | 2758 |
| NM_005080_193-211 | GAGGCAGCGAGCGGGGGCNN | 2759 | GCCCCCGCUCGCUGCCUCNN | 2760 |
| NM_005080_199-217 | GCGAGCGGGGGCUGCCCCNN | 2761 | GGGGCAGCCCCCGCUCGCNN | 2762 |
| NM_005080_292-310 | GUAGCAGCUCAGACUGCCANN | 2763 | UGGCAGUCUGAGCUGCUACNN | 2764 |
| NM_005080_341-359 | UGGAACAGCAAGUGGUAGANN | 2765 | UCUACCACUUGCUGUUCCANN | 2766 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_377-395 | AAAAACUUUUGCUAGAAAANN | 2767 | UUUUCUAGCAAAAGUUUUUNN | 2768 |
| NM_005080_519-537 | AGUGGCCGGGUCUGCUGAGNN | 2769 | CUCAGCAGACCCGGCCACUNN | 2770 |
| NM_005080_522-540 | GGCCGGGUCUGCUGAGUCCNN | 2771 | GGACUCAGCAGACCCGGCCNN | 2772 |
| NM_005080_577-595 | CAGGCCCAGUUGUCACCCCNN | 2773 | GGGGUGACAACUGGGCCUGNN | 2774 |
| NM_005080_599-617 | AGAACAUCUCCCCAUGGAUNN | 2775 | AUCCAUGGGGAGAUGUUCUNN | 2776 |
| NM_005080_754-772 | AAGGACCCAGUUCCUUACCNN | 2777 | GGUAAGGAACUGGGUCCUUNN | 2778 |
| NM_005080_888-906 | ACAGAGAGCCAAGCUAAUGNN | 2779 | CAUUAGCUUGGCUCUCUGUNN | 2780 |
| NM_005080_939-957 | CCCUCAGAGAAUGAUCACCNN | 2781 | GGUGAUCAUUCUCUGAGGGNN | 2782 |
| NM_005080_964-982 | UCAUUGUCUCAGUGAAGGANN | 2783 | UCCUUCACUGAGACAAUGANN | 2784 |
| NM_005080_1012-1030 | AGCUGGGUAUCUCAAAUCUNN | 2785 | AGAUUUGAGAUACCCAGCUNN | 2786 |
| NM_005080_1016-1034 | GGGUAUCUCAAAUCUGCUUNN | 2787 | AAGCAGAUUUGAGAUACCCNN | 2788 |
| NM_005080_1020-1038 | AUCUCAAAUCUGCUUUCAUNN | 2789 | AUGAAAGCAGAUUUGAGAUNN | 2790 |
| NM_005080_1025-1043 | AAAUCUGCUUUCAUCCAGCNN | 2791 | GCUGGAUGAAAGCAGAUUUNN | 2792 |
| NM_005080_1027-1045 | AUCUGCUUUCAUCCAGCCANN | 2793 | UGGCUGGAUGAAAGCAGAUNN | 2794 |
| NM_005080_1028-1046 | UCUGCUUUCAUCCAGCCACNN | 2795 | GUGGCUGGAUGAAAGCAGANN | 2796 |
| NM_005080_1030-1048 | UGCUUUCAUCCAGCCACUGNN | 2797 | CAGUGGCUGGAUGAAAGCNN | 2798 |
| NM_005080_1031-1049 | GCUUUCAUCCAGCCACUGCNN | 2799 | GCAGUGGCUGGAUGAAAGCNN | 2800 |
| NM_005080_1032-1050 | CUUUCAUCCAGCCACUGCCNN | 2801 | GGCAGUGGCUGGAUGAAAGNN | 2802 |
| NM_005080_1033-1051 | UUUCAUCCAGCCACUGCCCNN | 2803 | GGGCAGUGGCUGGAUGAAANN | 2804 |
| NM_005080_1056-1074 | CCAUCUUCCUGCCUACUGGNN | 2805 | CCAGUAGGCAGGAAGAUGGNN | 2806 |
| NM_005080_1057-1075 | CAUCUUCCUGCCUACUGGANN | 2807 | UCCAGUAGGCAGGAAGAUGNN | 2808 |
| NM_005080_1058-1076 | AUCUUCCUGCCUACUGGAUNN | 2809 | AUCCAGUAGGCAGGAAGAUNN | 2810 |
| NM_005080_1059-1077 | UCUUCCUGCCUACUGGAUGNN | 2811 | CAUCCAGUAGGCAGGAAGANN | 2812 |
| NM_005080_1061-1079 | UUCCUGCCUACUGGAUGCUNN | 2813 | AGCAUCCAGUAGGCAGGAANN | 2814 |
| NM_005080_1063-1081 | CCUGCCUACUGGAUGCUUANN | 2815 | UAAGCAUCCAGUAGGCAGGNN | 2816 |
| NM_005080_1069-1087 | UACUGGAUGCUUACAGUGANN | 2817 | UCACUGUAAGCAUCCAGUANN | 2818 |
| NM_005080_1071-1089 | CUGGAUGCUUACAGUGACUNN | 2819 | AGUCACUGUAAGCAUCCAGNN | 2820 |
| NM_005080_1073-1091 | GGAUGCUUACAGUGACUGUNN | 2821 | ACAGUCACUGUAAGCAUCCNN | 2822 |
| NM_005080_1075-1093 | AUGCUUACAGUGACUGUGGNN | 2823 | CCACAGUCACUGUAAGCAUNN | 2824 |
| NM_005080_1076-1094 | UGCUUACAGUGACUGUGGANN | 2825 | UCCACAGUCACUGUAAGCANN | 2826 |
| NM_005080_1078-1096 | CUUACAGUGACUGUGGAUANN | 2827 | UAUCCACAGUCACUGUAAGNN | 2828 |
| NM_005080_1139-1157 | UGGUGUAAACCAUUCUUGGNN | 2829 | CCAAGAAUGGUUUACACCANN | 2830 |
| NM_005080_1140-1158 | GGUGUAAACCAUUCUUGGGNN | 2831 | CCCAAGAAUGGUUUACACCNN | 2832 |
| NM_005080_1143-1161 | GUAAACCAUUCUUGGGAGGNN | 2833 | CCUCCCAAGAAUGGUUUACNN | 2834 |
| NM_005080_1144-1162 | UAAACCAUUCUUGGGAGGANN | 2835 | UCCUCCCAAGAAUGGUUUANN | 2836 |
| NM_005080_1145-1163 | AAACCAUUCUUGGGAGGACNN | 2837 | GUCCUCCCAAGAAUGGUUUNN | 2838 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_1148-1166 | CCAUUCUUGGGAGGACACUNN | 2839 | AGUGUCCUCCCAAGAAUGGNN | 2840 |
| NM_005080_1156-1174 | GGGAGGACACUUUUGCCAANN | 2841 | UUGGCAAAAGUGUCCUCCCNN | 2842 |
| NM_005080_1157-1175 | GGAGGACACUUUUGCCAAUNN | 2843 | AUUGGCAAAAGUGUCCUCCNN | 2844 |
| NM_005080_1159-1177 | AGGACACUUUUGCCAAUGANN | 2845 | UCAUUGGCAAAAGUGUCCUNN | 2846 |
| NM_005080_1160-1178 | GGACACUUUUGCCAAUGAANN | 2847 | UUCAUUGGCAAAAGUGUCCNN | 2848 |
| NM_005080_1190-1208 | GCUGAUUAGUGUCUAAGGANN | 2849 | UCCUUAGACACUAAUCAGCNN | 2850 |
| NM_005080_1218-1236 | UACUGUUGCCCUUUUCCUUNN | 2851 | AAGGAAAAGGGCAACAGUANN | 2852 |
| NM_005080_1220-1238 | CUGUUGCCCUUUUCCUUGANN | 2853 | UCAAGGAAAAGGGCAACAGNN | 2854 |
| NM_005080_1221-1239 | UGUUGCCCUUUUCCUUGACNN | 2855 | GUCAAGGAAAAGGGCAACANN | 2856 |
| NM_005080_1233-1251 | CCUUGACUAUUACACUGCCNN | 2857 | GGCAGUGUAAUAGUCAAGGNN | 2858 |
| NM_005080_1240-1258 | UAUUACACUGCCUGGAGGANN | 2859 | UCCUCCAGGCAGUGUAAUANN | 2860 |
| NM_005080_1241-1259 | AUUACACUGCCUGGAGGAUNN | 2861 | AUCCUCCAGGCAGUGUAAUNN | 2862 |
| NM_005080_1242-1260 | UUACACUGCCUGGAGGAUANN | 2863 | UAUCCUCCAGGCAGUGUAANN | 2864 |
| NM_005080_1243-1261 | UACACUGCCUGGAGGAUAGNN | 2865 | CUAUCCUCCAGGCAGUGUANN | 2866 |
| NM_005080_1282-1300 | UCAUUCAAAAGCCAAAAUNN | 2867 | AUUUUGGCUUUUUGAAUGNN | 2868 |
| NM_005080_1287-1305 | CAAAAGCCAAAAUAGAGANN | 2869 | UCUCUAUUUUGGCUUUUUGNN | 2870 |
| NM_005080_1289-1307 | AAAAGCCAAAAUAGAGAGUNN | 2871 | ACUCUCUAUUUUGGCUUUUNN | 2872 |
| NM_005080_1310-1328 | ACAGUCCUAGAGAAUUCCUNN | 2873 | AGGAAUUCUCUAGGACUGUNN | 2874 |
| NM_005080_1330-1348 | UAUUUGUUCAGAUCUCAUANN | 2875 | UAUGAGAUCUGAACAAAUANN | 2876 |
| NM_005080_1332-1350 | UUUGUUCAGAUCUCAUAGANN | 2877 | UCUAUGAGAUCUGAACAAANN | 2878 |
| NM_005080_1333-1351 | UUGUUCAGAUCUCAUAGAUNN | 2879 | AUCUAUGAGAUCUGAACAANN | 2880 |
| NM_005080_1369-1387 | UUUUGACAUCCAGCAGUCCNN | 2881 | GGACUGCUGGAUGUCAAAANN | 2882 |
| NM_005080_1370-1388 | UUUGACAUCCAGCAGUCCANN | 2883 | UGGACUGCUGGAUGUCAAANN | 2884 |
| NM_005080_1371-1389 | UUGACAUCCAGCAGUCCAANN | 2885 | UUGGACUGCUGGAUGUCAANN | 2886 |
| NM_005080_101-119 | UGCUUCUGUCGGGGCAGCCNN | 2887 | GGCUGCCCCGACAGAAGCANN | 2888 |
| NM_005080_1418-1436 | AAAUAUUACUAUAAUUGAGNN | 2889 | CUCAAUUAUAGUAAUAUUUNN | 2890 |
| NM_005080_1419-1437 | AAUAUUACUAUAAUUGAGANN | 2891 | UCUCAAUUAUAGUAAUAUUNN | 2892 |
| NM_005080_1422-1440 | AUUACUAUAAUUGAGAACUNN | 2893 | AGUUCUCAAUUAUAGUAAUNN | 2894 |
| NM_005080_102-120 | GCUUCUGUCGGGGCAGCCCNN | 2895 | GGGCUGCCCCGACAGAAGCNN | 2896 |
| NM_005080_1423-1441 | UUACUAUAAUUGAGAACUANN | 2897 | UAGUUCUCAAUUAUAGUAANN | 2898 |
| NM_005080_1425-1443 | ACUAUAAUUGAGAACUACANN | 2899 | UGUAGUUCUCAAUUAUAGUNN | 2900 |
| NM_005080_1427-1445 | UAUAAUUGAGAACUACAGCNN | 2901 | GCUGUAGUUCUCAAUUAUANN | 2902 |
| NM_005080_1428-1446 | AUAAUUGAGAACUACAGCUNN | 2903 | AGCUGUAGUUCUCAAUUAUNN | 2904 |
| NM_005080_1429-1447 | UAAUUGAGAACUACAGCUUNN | 2905 | AAGCUGUAGUUCUCAAUUANN | 2906 |
| NM_005080_1432-1450 | UUGAGAACUACAGCUUUUANN | 2907 | UAAAAGCUGUAGUUCUCAANN | 2908 |
| NM_005080_1433-1451 | UGAGAACUACAGCUUUUAANN | 2909 | UUAAAAGCUGUAGUUCUCANN | 2910 |
| NM_005080_1435-1453 | AGAACUACAGCUUUUAAGANN | 2911 | UCUUAAAAGCUGUAGUUCUNN | 2912 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_1439-1457 | CUACAGCUUUUAAGAUUGUNN | 2913 | ACAAUCUUAAAAGCUGUAGNN | 2914 |
| NM_005080_104-122 | UUCUGUCGGGGCAGCCCGCNN | 2915 | GCGGGCUGCCCCGACAGAANN | 2916 |
| NM_005080_1444-1462 | GCUUUUAAGAUUGUACUUUNN | 2917 | AAAGUACAAUCUUAAAAGCNN | 2918 |
| NM_005080_1445-1463 | CUUUUAAGAUUGUACUUUUNN | 2919 | AAAAGUACAAUCUUAAAAGNN | 2920 |
| NM_005080_1446-1464 | UUUUAAGAUUGUACUUUUANN | 2921 | UAAAAGUACAAUCUUAAAANN | 2922 |
| NM_005080_1447-1465 | UUUAAGAUUGUACUUUUAUNN | 2923 | AUAAAAGUACAAUCUUAAANN | 2924 |
| NM_005080_1448-1466 | UUAAGAUUGUACUUUUAUCNN | 2925 | GAUAAAAGUACAAUCUUAANN | 2926 |
| NM_005080_1451-1469 | AGAUUGUACUUUUAUCUUANN | 2927 | UAAGAUAAAAGUACAAUCNN | 2928 |
| NM_005080_1454-1472 | UUGUACUUUUAUCUUAAAANN | 2929 | UUUUAAGAUAAAAGUACAANN | 2930 |
| NM_005080_1458-1476 | ACUUUUAUCUUAAAAGGGUNN | 2931 | ACCCUUUUAAGAUAAAAGUNN | 2932 |
| NM_005080_1459-1477 | CUUUUAUCUUAAAAGGGUGNN | 2933 | CACCCUUUUAAGAUAAAAGNN | 2934 |
| NM_005080_106-124 | CUGUCGGGCAGCCCGCCUNN | 2935 | AGGCGGGCUGCCCCGACAGNN | 2936 |
| NM_005080_1466-1484 | CUUAAAAGGGUGGUAGUUUNN | 2937 | AAACUACCACCCUUUUAAGNN | 2938 |
| NM_005080_1486-1504 | CCCUAAAAUACUUAUUAUGNN | 2939 | CAUAAUAAGUAUUUUAGGGNN | 2940 |
| NM_005080_1487-1505 | CCUAAAAUACUUAUUAUGUNN | 2941 | ACAUAAUAAGUAUUUUAGGNN | 2942 |
| NM_005080_1489-1507 | UAAAAUACUUAUUAUGUAANN | 2943 | UUACAUAAUAAGUAUUUUANN | 2944 |
| NM_005080_1490-1508 | AAAAUACUUAUUAUGUAAGNN | 2945 | CUUACAUAAUAAGUAUUUUNN | 2946 |
| NM_005080_1491-1509 | AAAUACUUAUUAUGUAAGGNN | 2947 | CCUUACAUAAUAAGUAUUUNN | 2948 |
| NM_005080_109-127 | UCGGGGCAGCCCGCCUCCGNN | 2949 | CGGAGGCGGGCUGCCCCGANN | 2950 |
| NM_005080_1497-1515 | UUAUUAUGUAAGGGUCAUUNN | 2951 | AAUGACCCUUACAUAAUAANN | 2952 |
| NM_005080_1498-1516 | UAUUAUGUAAGGGUCAUUANN | 2953 | UAAUGACCCUUACAUAAUANN | 2954 |
| NM_005080_110-128 | CGGGGCAGCCCGCCUCCGCNN | 2955 | GCGGAGGCGGGCUGCCCCGNN | 2956 |
| NM_005080_1511-1529 | UCAUUAGACAAAUGUCUUGNN | 2957 | CAAGACAUUUGUCUAAUGANN | 2958 |
| NM_005080_1513-1531 | AUUAGACAAAUGUCUUGAANN | 2959 | UUCAAGACAUUUGUCUAAUNN | 2960 |
| NM_005080_1516-1534 | AGACAAAUGUCUUGAAGUANN | 2961 | UACUUCAAGACAUUUGUCUNN | 2962 |
| NM_005080_1517-1535 | GACAAAUGUCUUGAAGUAGNN | 2963 | CUACUUCAAGACAUUUGUCNN | 2964 |
| NM_005080_1518-1536 | ACAAAUGUCUUGAAGUAGANN | 2965 | UCUACUUCAAGACAUUUGUNN | 2966 |
| NM_005080_1547-1565 | AUGAAUGGUUCUUUAUCAUNN | 2967 | AUGAUAAAGAACCAUUCAUNN | 2968 |
| NM_005080_1550-1568 | AAUGGUUCUUUAUCAUUUCNN | 2969 | GAAAUGAUAAAGAACCAUUNN | 2970 |
| NM_005080_1551-1569 | AUGGUUCUUUAUCAUUUCUNN | 2971 | AGAAAUGAUAAAGAACCAUNN | 2972 |
| NM_005080_1552-1570 | UGGUUCUUUAUCAUUUCUCNN | 2973 | GAGAAAUGAUAAAGAACCANN | 2974 |
| NM_005080_1554-1572 | GUUCUUUAUCAUUUCUCUUNN | 2975 | AAGAGAAAUGAUAAAGAACNN | 2976 |
| NM_005080_1559-1577 | UUAUCAUUUCUCUUCCCCCNN | 2977 | GGGGGAAGAGAAAUGAUAANN | 2978 |
| NM_005080_1560-1578 | UAUCAUUUCUCUUCCCCCUNN | 2979 | AGGGGGAAGAGAAAUGAUANN | 2980 |
| NM_005080_1563-1581 | CAUUUCUCUUCCCCCUUUUNN | 2981 | AAAAGGGGGAAGAGAAAUGNN | 2982 |
| NM_005080_1565-1583 | UUUCUCUUCCCCCUUUUUGNN | 2983 | CAAAAGGGGGAAGAGAAANN | 2984 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
| --- | --- | --- | --- | --- |
| NM_005080_1566-1584 | UUCUCUUCCCCCUUUUUGGNN | 2985 | CCAAAAAGGGGGAAGAGAANN | 2986 |
| NM_005080_1570-1588 | CUUCCCCCUUUUUGGCAUCNN | 2987 | GAUGCCAAAAAGGGGGAAGNN | 2988 |
| NM_005080_1573-1591 | CCCCCUUUUUGGCAUCCUGNN | 2989 | CAGGAUGCCAAAAAGGGGNN | 2990 |
| NM_005080_1578-1596 | UUUUUGGCAUCCUGGCUUGNN | 2991 | CAAGCCAGGAUGCCAAAAANN | 2992 |
| NM_005080_1579-1597 | UUUUGGCAUCCUGGCUUGCNN | 2993 | GCAAGCCAGGAUGCCAAAANN | 2994 |
| NM_005080_1580-1598 | UUUGGCAUCCUGGCUUGCCNN | 2995 | GGCAAGCCAGGAUGCCAAANN | 2996 |
| NM_005080_1581-1599 | UUGGCAUCCUGGCUUGCCUNN | 2997 | AGGCAAGCCAGGAUGCCAANN | 2998 |
| NM_005080_1583-1601 | GGCAUCCUGGCUUGCCUCCNN | 2999 | GGAGGCAAGCCAGGAUGCCNN | 3000 |
| NM_005080_1584-1602 | GCAUCCUGGCUUGCCUCCANN | 3001 | UGGAGGCAAGCCAGGAUGCNN | 3002 |
| NM_005080_1586-1604 | AUCCUGGCUUGCCUCCAGUNN | 3003 | ACUGGAGGCAAGCCAGGAUNN | 3004 |
| NM_005080_1589-1607 | CUGGCUUGCCUCCAGUUUUNN | 3005 | AAAACUGGAGGCAAGCCAGNN | 3006 |
| NM_005080_1590-1608 | UGGCUUGCCUCCAGUUUUANN | 3007 | UAAAACUGGAGGCAAGCCANN | 3008 |
| NM_005080_1595-1613 | UGCCUCCAGUUUUAGGUCCNN | 3009 | GGACCUAAAACUGGAGGCANN | 3010 |
| NM_005080_1616-1634 | UAGUUUGCUUCUGUAAGCANN | 3011 | UGCUUACAGAAGCAAACUANN | 3012 |
| NM_005080_1617-1635 | AGUUUGCUUCUGUAAGCAANN | 3013 | UUGCUUACAGAAGCAAACUNN | 3014 |
| NM_005080_1643-1661 | ACCUGCUGAGGGGCUCUUNN | 3015 | AAGAGCCCCCUCAGCAGGUNN | 3016 |
| NM_005080_1645-1663 | CUGCUGAGGGGCUCUUUCNN | 3017 | GAAAGAGCCCCCUCAGCAGNN | 3018 |
| NM_005080_1646-1664 | UGCUGAGGGGCUCUUUCCNN | 3019 | GGAAAGAGCCCCCUCAGCANN | 3020 |
| NM_005080_1647-1665 | GCUGAGGGGCUCUUUCCCNN | 3021 | GGGAAAGAGCCCCCUCAGCNN | 3022 |
| NM_005080_1648-1666 | CUGAGGGGCUCUUUCCCUNN | 3023 | AGGGAAAGAGCCCCCUCAGNN | 3024 |
| NM_005080_1649-1667 | UGAGGGGCUCUUUCCCUCNN | 3025 | GAGGGAAAGAGCCCCCUCANN | 3026 |
| NM_005080_1679-1697 | AAGUAAGAUCAAGAAUCUUNN | 3027 | AAGAUUCUUGAUCUUACUUNN | 3028 |
| NM_005080_1680-1698 | AGUAAGAUCAAGAAUCUUUNN | 3029 | AAAGAUUCUUGAUCUUACUNN | 3030 |
| NM_005080_1681-1699 | GUAAGAUCAAGAAUCUUUUNN | 3031 | AAAAGAUUCUUGAUCUUACNN | 3032 |
| NM_005080_1682-1700 | UAAGAUCAAGAAUCUUUUGNN | 3033 | CAAAAGAUUCUUGAUCUUANN | 3034 |
| NM_005080_1683-1701 | AAGAUCAAGAAUCUUUUGUNN | 3035 | ACAAAAGAUUCUUGAUCUUNN | 3036 |
| NM_005080_1684-1702 | AGAUCAAGAAUCUUUUGUGNN | 3037 | CACAAAAGAUUCUUGAUCUNN | 3038 |
| NM_005080_1687-1705 | UCAAGAAUCUUUUGUGAAANN | 3039 | UUUCACAAAAGAUUCUUGANN | 3040 |
| NM_005080_1709-1727 | UAGAAAUUUACUAUGUAAANN | 3041 | UUUACAUAGUAAAUUUCUANN | 3042 |
| NM_005080_1710-1728 | AGAAAUUUACUAUGUAAAUNN | 3043 | AUUUACAUAGUAAAUUUCUNN | 3044 |
| NM_005080_1711-1729 | GAAAUUUACUAUGUAAAUGNN | 3045 | CAUUUACAUAGUAAAUUUCNN | 3046 |
| NM_005080_1712-1730 | AAAUUUACUAUGUAAAUGCNN | 3047 | GCAUUUACAUAGUAAAUUUNN | 3048 |
| NM_005080_1714-1732 | AUUUACUAUGUAAAUGCUUNN | 3049 | AAGCAUUUACAUAGUAAAUNN | 3050 |
| NM_005080_1715-1733 | UUUACUAUGUAAAUGCUUGNN | 3051 | CAAGCAUUUACAUAGUAAANN | 3052 |
| NM_005080_1717-1735 | UACUAUGUAAAUGCUUGAUNN | 3053 | AUCAAGCAUUUACAUAGUANN | 3054 |
| NM_005080_1719-1737 | CUAUGUAAAUGCUUGAUGGNN | 3055 | CCAUCAAGCAUUUACAUAGNN | 3056 |
| NM_005080_1721-1739 | AUGUAAAUGCUUGAUGGAANN | 3057 | UUCCAUCAAGCAUUUACAUNN | 3058 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_1722-1740 | UGUAAAUGCUUGAUGGAAUNN | 3059 | AUUCCAUCAAGCAUUUACANN | 3060 |
| NM_005080_1723-1741 | GUAAAUGCUUGAUGGAAUUNN | 3061 | AAUUCCAUCAAGCAUUUACNN | 3062 |
| NM_005080_1726-1744 | AAUGCUUGAUGGAAUUUUUNN | 3063 | AAAAAUUCCAUCAAGCAUUNN | 3064 |
| NM_005080_1727-1745 | AUGCUUGAUGGAAUUUUUUNN | 3065 | AAAAAAUUCCAUCAAGCAUNN | 3066 |
| NM_005080_1728-1746 | UGCUUGAUGGAAUUUUUUCNN | 3067 | GAAAAAAUUCCAUCAAGCANN | 3068 |
| NM_005080_1729-1747 | GCUUGAUGGAAUUUUUUCCNN | 3069 | GGAAAAAAUUCCAUCAAGCNN | 3070 |
| NM_005080_1736-1754 | GGAAUUUUUUCCUGCUAGUNN | 3071 | ACUAGCAGGAAAAAAUUCCNN | 3072 |
| NM_005080_1739-1757 | AUUUUUUCCUGCUAGUGUANN | 3073 | UACACUAGCAGGAAAAAAUNN | 3074 |
| NM_005080_1746-1764 | CCUGCUAGUGUAGCUUCUGNN | 3075 | CAGAAGCUACACUAGCAGGNN | 3076 |
| NM_005080_1747-1765 | CUGCUAGUGUAGCUUCUGANN | 3077 | UCAGAAGCUACACUAGCAGNN | 3078 |
| NM_005080_1749-1767 | GCUAGUGUAGCUUCUGAAANN | 3079 | UUUCAGAAGCUACACUAGCNN | 3080 |
| NM_005080_1750-1768 | CUAGUGUAGCUUCUGAAAGNN | 3081 | CUUUCAGAAGCUACACUAGNN | 3082 |
| NM_005080_1751-1769 | UAGUGUAGCUUCUGAAAGGNN | 3083 | CCUUUCAGAAGCUACACUANN | 3084 |
| NM_005080_1752-1770 | AGUGUAGCUUCUGAAAGGUNN | 3085 | ACCUUUCAGAAGCUACACUNN | 3086 |
| NM_005080_1753-1771 | GUGUAGCUUCUGAAAGGUGNN | 3087 | CACCUUUCAGAAGCUACACNN | 3088 |
| NM_005080_1755-1773 | GUAGCUUCUGAAAGGUGCUNN | 3089 | AGCACCUUUCAGAAGCUACNN | 3090 |
| NM_005080_1758-1776 | GCUUCUGAAAGGUGCUUUCNN | 3091 | GAAAGCACCUUUCAGAAGCNN | 3092 |
| NM_005080_1781-1799 | UUUAUUUAAAACUACCCAUNN | 3093 | AUGGGUAGUUUUAAAUAAANN | 3094 |
| NM_005080_1782-1800 | UUAUUUAAAACUACCCAUGNN | 3095 | CAUGGGUAGUUUUAAAUAANN | 3096 |
| NM_005080_1784-1802 | AUUUAAAACUACCCAUGCANN | 3097 | UGCAUGGGUAGUUUUAAAUNN | 3098 |
| NM_005080_1785-1803 | UUUAAAACUACCCAUGCAANN | 3099 | UUGCAUGGGUAGUUUUAAANN | 3100 |
| NM_005080_1788-1806 | AAAACUACCCAUGCAAUUANN | 3101 | UAAUUGCAUGGGUAGUUUUNN | 3102 |
| NM_005080_1792-1810 | CUACCCAUGCAAUUAAAAGNN | 3103 | CUUUUAAUUGCAUGGGUAGNN | 3104 |
| NM_005080_1793-1811 | UACCCAUGCAAUUAAAAGGNN | 3105 | CCUUUUAAUUGCAUGGGUANN | 3106 |
| NM_005080_1795-1813 | CCCAUGCAAUUAAAAGGUANN | 3107 | UACCUUUUAAUUGCAUGGGNN | 3108 |
| NM_005080_1798-1816 | AUGCAAUUAAAAGGUACAANN | 3109 | UUGUACCUUUUAAUUGCAUNN | 3110 |
| NM_005080_1799-1817 | UGCAAUUAAAAGGUACAAUNN | 3111 | AUUGUACCUUUUAAUUGCANN | 3112 |
| NM_005080_1800-1818 | GCAAUUAAAAGGUACAAUGNN | 3113 | CAUUGUACCUUUUAAUUGCNN | 3114 |
| NM_005080_1801-1819 | CAAUUAAAAGGUACAAUGCNN | 3115 | GCAUUGUACCUUUUAAUUGNN | 3116 |
| NM_005080_146-164 | GCCAGGCCCUGCCGCUCAUNN | 3117 | AUGAGCGGCAGGGCCUGGCNN | 3118 |
| NM_005080_147-165 | CCAGGCCCUGCCGCUCAUGNN | 3119 | CAUGAGCGGCAGGGCCUGGNN | 3120 |
| NM_005080_148-166 | CAGGCCCUGCCGCUCAUGGNN | 3121 | CCAUGAGCGGCAGGGCCUGNN | 3122 |
| NM_005080_149-167 | AGGCCCUGCCGCUCAUGGUNN | 3123 | ACCAUGAGCGGCAGGGCCUNN | 3124 |
| NM_005080_155-173 | UGCCGCUCAUGGUGCCAGCNN | 3125 | GCUGGCACCAUGAGCGGCANN | 3126 |
| NM_005080_157-175 | CCGCUCAUGGUGCCAGCCCNN | 3127 | GGGCUGGCACCAUGAGCGGNN | 3128 |
| NM_005080_158-176 | CGCUCAUGGUGCCAGCCCANN | 3129 | UGGGCUGGCACCAUGAGCGNN | 3130 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_159-177 | GCUCAUGGUGCCAGCCCAGNN | 3131 | CUGGGCUGGCACCAUGAGCNN | 3132 |
| NM_005080_188-206 | GCCCGGAGGCAGCGAGCGGNN | 3133 | CCGCUCGCUGCCUCCGGGCNN | 3134 |
| NM_005080_189-207 | CCCGGAGGCAGCGAGCGGGNN | 3135 | CCCGCUCGCUGCCUCCGGGNN | 3136 |
| NM_005080_195-213 | GGCAGCGAGCGGGGGCUGNN | 3137 | CAGCCCCCCGCUCGCUGCCNN | 3138 |
| NM_005080_196-214 | GCAGCGAGCGGGGGCUGCNN | 3139 | GCAGCCCCCCGCUCGCUGCNN | 3140 |
| NM_005080_197-215 | CAGCGAGCGGGGGCUGCCNN | 3141 | GGCAGCCCCCCGCUCGCUGNN | 3142 |
| NM_005080_198-216 | AGCGAGCGGGGGCUGCCCNN | 3143 | GGGCAGCCCCCCGCUCGCUNN | 3144 |
| NM_005080_205-223 | GGGGGCUGCCCCAGGCGCNN | 3145 | GCGCCUGGGGCAGCCCCCNN | 3146 |
| NM_005080_206-224 | GGGGGCUGCCCCAGGCGCGNN | 3147 | CGCGCCUGGGGCAGCCCCCNN | 3148 |
| NM_005080_207-225 | GGGGCUGCCCCAGGCGCGCNN | 3149 | GCGCGCCUGGGGCAGCCCCNN | 3150 |
| NM_005080_211-229 | CUGCCCCAGGCGCGCAAGCNN | 3151 | GCUUGCGCGCCUGGGGCAGNN | 3152 |
| NM_005080_250-268 | AGCCCCGAGGAGAAGGCGCNN | 3153 | GCGCCUUCUCCUCGGGGCUNN | 3154 |
| NM_005080_256-274 | GAGGAGAAGGCGCUGAGGANN | 3155 | UCCUCAGCGCCUUCUCCUCNN | 3156 |
| NM_005080_263-281 | AGGCGCUGAGGAGGAAACUNN | 3157 | AGUUUCCUCCUCAGCGCCUNN | 3158 |
| NM_005080_264-282 | GGCGCUGAGGAGGAAACUGNN | 3159 | CAGUUUCCUCCUCAGCGCCNN | 3160 |
| NM_005080_285-303 | AAACAGAGUAGCAGCUCAGNN | 3161 | CUGAGCUGCUACUCUGUUUNN | 3162 |
| NM_005080_286-304 | AACAGAGUAGCAGCUCAGANN | 3163 | UCUGAGCUGCUACUCUGUUNN | 3164 |
| NM_005080_287-305 | ACAGAGUAGCAGCUCAGACNN | 3165 | GUCUGAGCUGCUACUCUGUNN | 3166 |
| NM_005080_294-312 | AGCAGCUCAGACUGCCAGNN | 3167 | UCUGGCAGUCUGAGCUGCUNN | 3168 |
| NM_005080_295-313 | GCAGCUCAGACUGCCAGANN | 3169 | CUCUGGCAGUCUGAGCUGCNN | 3170 |
| NM_005080_296-314 | CAGCUCAGACUGCCAGAGANN | 3171 | UCUCUGGCAGUCUGAGCUGNN | 3172 |
| NM_005080_298-316 | GCUCAGACUGCCAGAGAUCNN | 3173 | GAUCUCUGGCAGUCUGAGCNN | 3174 |
| NM_005080_303-321 | GACUGCCAGAGAUCGAAAGNN | 3175 | CUUUCGAUCUCUGGCAGUCNN | 3176 |
| NM_005080_332-350 | UGAGUGAGCUGGAACAGCANN | 3177 | UGCUGUUCCAGCUCACUCANN | 3178 |
| NM_005080_339-357 | GCUGGAACAGCAAGUGGUANN | 3179 | UACCACUUGCUGUUCCAGCNN | 3180 |
| NM_005080_340-358 | CUGGAACAGCAAGUGGUAGNN | 3181 | CUACCACUUGCUGUUCCAGNN | 3182 |
| NM_005080_345-363 | ACAGCAAGUGGUAGAUUUANN | 3183 | UAAAUCUACCACUUGCUGUNN | 3184 |
| NM_005080_346-364 | CAGCAAGUGGUAGAUUUAGNN | 3185 | CUAAAUCUACCACUUGCUGNN | 3186 |
| NM_005080_348-366 | GCAAGUGGUAGAUUUAGAANN | 3187 | UUCUAAAUCUACCACUUGCNN | 3188 |
| NM_005080_349-367 | CAAGUGGUAGAUUUAGAAGNN | 3189 | CUUCUAAAUCUACCACUUGNN | 3190 |
| NM_005080_352-370 | GUGGUAGAUUUAGAAGAAGNN | 3191 | CUUCUUCUAAAUCUACCACNN | 3192 |
| NM_005080_353-371 | UGGUAGAUUUAGAAGAAGANN | 3193 | UCUUCUUCUAAAUCUACCANN | 3194 |
| NM_005080_354-372 | GGUAGAUUUAGAAGAAGAGNN | 3195 | CUCUUCUUCUAAAUCUACCNN | 3196 |
| NM_005080_355-373 | GUAGAUUUAGAAGAAGAGANN | 3197 | UCUCUUCUUCUAAAUCUACNN | 3198 |
| NM_005080_361-379 | UUAGAAGAAGAGAACCAAANN | 3199 | UUUGGUUCUCUUCUUCUAANN | 3200 |
| NM_005080_366-384 | AGAAGAGAACCAAAAACUUNN | 3201 | AAGUUUUUGGUUCUCUUCUNN | 3202 |
| NM_005080_369-387 | AGAGAACCAAAAACUUUUGNN | 3203 | CAAAAGUUUUUGGUUCUCUNN | 3204 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
| --- | --- | --- | --- | --- |
| NM_005080_370-388 | GAGAACCAAAAACUUUUGCNN | 3205 | GCAAAAGUUUUUGGUUCUCNN | 3206 |
| NM_005080_372-390 | GAACCAAAAACUUUUGCUANN | 3207 | UAGCAAAAGUUUUUGGUUCNN | 3208 |
| NM_005080_376-394 | CAAAAACUUUUGCUAGAAANN | 3209 | UUUCUAGCAAAAGUUUUUGNN | 3210 |
| NM_005080_381-399 | ACUUUUGCUAGAAAAUCAGNN | 3211 | CUGAUUUUCUAGCAAAAGUNN | 3212 |
| NM_005080_384-402 | UUUGCUAGAAAAUCAGCUUNN | 3213 | AAGCUGAUUUUCUAGCAAANN | 3214 |
| NM_005080_388-406 | CUAGAAAAUCAGCUUUUACNN | 3215 | GUAAAAGCUGAUUUUCUAGNN | 3216 |
| NM_005080_392-410 | AAAAUCAGCUUUUACGAGANN | 3217 | UCUCGUAAAAGCUGAUUUUNN | 3218 |
| NM_005080_394-412 | AAUCAGCUUUUACGAGAGANN | 3219 | UCUCUCGUAAAAGCUGAUUNN | 3220 |
| NM_005080_396-414 | UCAGCUUUUACGAGAGAAANN | 3221 | UUUCUCUCGUAAAAGCUGANN | 3222 |
| NM_005080_400-418 | CUUUUACGAGAGAAAACUCNN | 3223 | GAGUUUUCUCUCGUAAAAGNN | 3224 |
| NM_005080_421-439 | GGCCUUGUAGUUGAGAACCNN | 3225 | GGUUCUCAACUACAAGGCCNN | 3226 |
| NM_005080_422-440 | GCCUUGUAGUUGAGAACCANN | 3227 | UGGUUCUCAACUACAAGGCNN | 3228 |
| NM_005080_423-441 | CCUUGUAGUUGAGAACCAGNN | 3229 | CUGGUUCUCAACUACAAGGNN | 3230 |
| NM_005080_425-443 | UUGUAGUUGAGAACCAGGANN | 3231 | UCCUGGUUCUCAACUACAANN | 3232 |
| NM_005080_428-446 | UAGUUGAGAACCAGGAGUUNN | 3233 | AACUCCUGGUUCUCAACUANN | 3234 |
| NM_005080_429-447 | AGUUGAGAACCAGGAGUUANN | 3235 | UAACUCCUGGUUCUCAACUNN | 3236 |
| NM_005080_432-450 | UGAGAACCAGGAGUUAAGANN | 3237 | UCUUAACUCCUGGUUCUCANN | 3238 |
| NM_005080_433-451 | GAGAACCAGGAGUUAAGACNN | 3239 | GUCUUAACUCCUGGUUCUCNN | 3240 |
| NM_005080_434-452 | AGAACCAGGAGUUAAGACANN | 3241 | UGUCUUAACUCCUGGUUCUNN | 3242 |
| NM_005080_435-453 | GAACCAGGAGUUAAGACAGNN | 3243 | CUGUCUUAACUCCUGGUUCNN | 3244 |
| NM_005080_436-454 | AACCAGGAGUUAAGACAGCNN | 3245 | GCUGUCUUAACUCCUGGUUNN | 3246 |
| NM_005080_459-477 | GGGGAUGGAUGCCCUGGUUNN | 3247 | AACCAGGGCAUCCAUCCCCNN | 3248 |
| NM_005080_460-478 | GGGAUGGAUGCCCUGGUUGNN | 3249 | CAACCAGGGCAUCCAUCCCNN | 3250 |
| NM_005080_462-480 | GAUGGAUGCCCUGGUUGCUNN | 3251 | AGCAACCAGGGCAUCCAUCNN | 3252 |
| NM_005080_486-504 | GGAGGCGGAAGCCAAGGGGNN | 3253 | CCCCUUGGCUUCCGCCUCCNN | 3254 |
| NM_005080_510-528 | AGUGAGGCCAGUGGCCGGGNN | 3255 | CCCGGCCACUGGCCUCACUNN | 3256 |
| NM_005080_513-531 | GAGGCCAGUGGCCGGGUCUNN | 3257 | AGACCCGGCCACUGGCCUCNN | 3258 |
| NM_005080_514-532 | AGGCCAGUGGCCGGGUCUGNN | 3259 | CAGACCCGGCCACUGGCCUNN | 3260 |
| NM_005080_515-533 | GGCCAGUGGCCGGGUCUGCNN | 3261 | GCAGACCCGGCCACUGGCCNN | 3262 |
| NM_005080_516-534 | GCCAGUGGCCGGGUCUGCUNN | 3263 | AGCAGACCCGGCCACUGGCNN | 3264 |
| NM_005080_520-538 | GUGGCCGGGUCUGCUGAGUNN | 3265 | ACUCAGCAGACCCGGCCACNN | 3266 |
| NM_005080_521-539 | UGGCCGGGUCUGCUGAGUCNN | 3267 | GACUCAGCAGACCCGGCCANN | 3268 |
| NM_005080_523-541 | GCCGGGUCUGCUGAGUCCGNN | 3269 | CGGACUCAGCAGACCCGGCNN | 3270 |
| NM_005080_578-596 | AGGCCCAGUUGUCACCCCUNN | 3271 | AGGGGUGACAACUGGGCCUNN | 3272 |
| NM_005080_581-599 | CCCAGUUGUCACCCCUCCANN | 3273 | UGGAGGGGUGACAACUGGGNN | 3274 |
| NM_005080_582-600 | CCAGUUGUCACCCCUCCAGNN | 3275 | CUGGAGGGGUGACAACUGGNN | 3276 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_583-601 | CAGUUGUCACCCCUCCAGANN | 3277 | UCUGGAGGGGUGACAACUGNN | 3278 |
| NM_005080_584-602 | AGUUGUCACCCCUCCAGAANN | 3279 | UUCUGGAGGGGUGACAACUNN | 3280 |
| NM_005080_585-603 | GUUGUCACCCCUCCAGAACNN | 3281 | GUUCUGGAGGGGUGACAACNN | 3282 |
| NM_005080_586-604 | UUGUCACCCCUCCAGAACANN | 3283 | UGUUCUGGAGGGGUGACAANN | 3284 |
| NM_005080_587-605 | UGUCACCCCUCCAGAACAUNN | 3285 | AUGUUCUGGAGGGGUGACANN | 3286 |
| NM_005080_588-606 | GUCACCCCUCCAGAACAUCNN | 3287 | GAUGUUCUGGAGGGGUGACNN | 3288 |
| NM_005080_589-607 | UCACCCCUCCAGAACAUCUNN | 3289 | AGAUGUUCUGGAGGGGUGANN | 3290 |
| NM_005080_590-608 | CACCCCUCCAGAACAUCUCNN | 3291 | GAGAUGUUCUGGAGGGGUGNN | 3292 |
| NM_005080_591-609 | ACCCCUCCAGAACAUCUCCNN | 3293 | GGAGAUGUUCUGGAGGGGUNN | 3294 |
| NM_005080_597-615 | CCAGAACAUCUCCCCAUGGNN | 3295 | CCAUGGGGAGAUGUUCUGGNN | 3296 |
| NM_005080_600-618 | GAACAUCUCCCCAUGGAUUNN | 3297 | AAUCCAUGGGGAGAUGUUCNN | 3298 |
| NM_005080_603-621 | CAUCUCCCCAUGGAUUCUGNN | 3299 | CAGAAUCCAUGGGGAGAUGNN | 3300 |
| NM_005080_619-637 | CUGGCGGUAUUGACUCUUCNN | 3301 | GAAGAGUCAAUACCGCCAGNN | 3302 |
| NM_005080_620-638 | UGGCGGUAUUGACUCUUCANN | 3303 | UGAAGAGUCAAUACCGCCANN | 3304 |
| NM_005080_622-640 | GCGGUAUUGACUCUUCAGNN | 3305 | UCUGAAGAGUCAAUACCGCNN | 3306 |
| NM_005080_623-641 | CGGUAUUGACUCUUCAGAUNN | 3307 | AUCUGAAGAGUCAAUACCGNN | 3308 |
| NM_005080_624-642 | GGUAUUGACUCUUCAGAUUNN | 3309 | AAUCUGAAGAGUCAAUACCNN | 3310 |
| NM_005080_625-643 | GUAUUGACUCUUCAGAUUCNN | 3311 | GAAUCUGAAGAGUCAAUACNN | 3312 |
| NM_005080_626-644 | UAUUGACUCUUCAGAUUCANN | 3313 | UGAAUCUGAAGAGUCAAUANN | 3314 |
| NM_005080_629-647 | UGACUCUUCAGAUUCAGAGNN | 3315 | CUCUGAAUCUGAAGAGUCANN | 3316 |
| NM_005080_632-650 | CUCUUCAGAUUCAGAGUCUNN | 3317 | AGACUCUGAAUCUGAAGAGNN | 3318 |
| NM_005080_634-652 | CUUCAGAUUCAGAGUCUGANN | 3319 | UCAGACUCUGAAUCUGAAGNN | 3320 |
| NM_005080_637-655 | CAGAUUCAGAGUCUGAUAUNN | 3321 | AUAUCAGACUCUGAAUCUGNN | 3322 |
| NM_005080_638-656 | AGAUUCAGAGUCUGAUAUCNN | 3323 | GAUAUCAGACUCUGAAUCUNN | 3324 |
| NM_005080_639-657 | GAUUCAGAGUCUGAUAUCCNN | 3325 | GGAUAUCAGACUCUGAAUCNN | 3326 |
| NM_005080_642-660 | UCAGAGUCUGAUAUCCUGUNN | 3327 | ACAGGAUAUCAGACUCUGANN | 3328 |
| NM_005080_643-661 | CAGAGUCUGAUAUCCUGUUNN | 3329 | AACAGGAUAUCAGACUCUGNN | 3330 |
| NM_005080_644-662 | AGAGUCUGAUAUCCUGUUGNN | 3331 | CAACAGGAUAUCAGACUCUNN | 3332 |
| NM_005080_646-664 | AGUCUGAUAUCCUGUUGGGNN | 3333 | CCCAACAGGAUAUCAGACUNN | 3334 |
| NM_005080_649-667 | CUGAUAUCCUGUUGGGCAUNN | 3335 | AUGCCCAACAGGAUAUCAGNN | 3336 |
| NM_005080_650-668 | UGAUAUCCUGUUGGGCAUUNN | 3337 | AAUGCCCAACAGGAUAUCANN | 3338 |
| NM_005080_653-671 | UAUCCUGUUGGGCAUUCUGNN | 3339 | CAGAAUGCCCAACAGGAUANN | 3340 |
| NM_005080_658-676 | UGUUGGGCAUUCUGGACAANN | 3341 | UUGUCCAGAAUGCCCAACANN | 3342 |
| NM_005080_659-677 | GUUGGGCAUUCUGGACAACNN | 3343 | GUUGUCCAGAAUGCCCAACNN | 3344 |
| NM_005080_660-678 | UUGGGCAUUCUGGACAACUNN | 3345 | AGUUGUCCAGAAUGCCCAANN | 3346 |
| NM_005080_663-681 | GGCAUUCUGGACAACUUGGNN | 3347 | CCAAGUUGUCCAGAAUGCCNN | 3348 |
| NM_005080_664-682 | GCAUUCUGGACAACUUGGANN | 3349 | UCCAAGUUGUCCAGAAUGCNN | 3350 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_668-686 | UCUGGACAACUUGGACCCANN | 3351 | UGGGUCCAAGUUGUCCAGANN | 3352 |
| NM_005080_671-689 | GGACAACUUGGACCCAGUCNN | 3353 | GACUGGGUCCAAGUUGUCCNN | 3354 |
| NM_005080_676-694 | ACUUGGACCCAGUCAUGUUNN | 3355 | AACAUGACUGGGUCCAAGUNN | 3356 |
| NM_005080_677-695 | CUUGGACCCAGUCAUGUUCNN | 3357 | GAACAUGACUGGGUCCAAGNN | 3358 |
| NM_005080_679-697 | UGGACCCAGUCAUGUUCUUNN | 3359 | AAGAACAUGACUGGGUCCANN | 3360 |
| NM_005080_680-698 | GGACCCAGUCAUGUUCUUCNN | 3361 | GAAGAACAUGACUGGGUCCNN | 3362 |
| NM_005080_682-700 | ACCCAGUCAUGUUCUUCAANN | 3363 | UUGAAGAACAUGACUGGGUNN | 3364 |
| NM_005080_687-705 | GUCAUGUUCUUCAAAUGCCNN | 3365 | GGCAUUUGAAGAACAUGACNN | 3366 |
| NM_005080_689-707 | CAUGUUCUUCAAAUGCCCUNN | 3367 | AGGGCAUUUGAAGAACAUGNN | 3368 |
| NM_005080_695-713 | CUUCAAAUGCCCUUCCCCANN | 3369 | UGGGGAAGGGCAUUUGAAGNN | 3370 |
| NM_005080_696-714 | UUCAAAUGCCCUUCCCCAGNN | 3371 | CUGGGGAAGGGCAUUUGAANN | 3372 |
| NM_005080_698-716 | CAAAUGCCCUUCCCCAGAGNN | 3373 | CUCUGGGGAAGGGCAUUUGNN | 3374 |
| NM_005080_731-749 | GGAGCUCCCAGAGGUCUACNN | 3375 | GUAGACCUCUGGGAGCUCCNN | 3376 |
| NM_005080_732-750 | GAGCUCCCAGAGGUCUACCNN | 3377 | GGUAGACCUCUGGGAGCUCNN | 3378 |
| NM_005080_733-751 | AGCUCCCAGAGGUCUACCCNN | 3379 | GGGUAGACCUCUGGGAGCUNN | 3380 |
| NM_005080_736-754 | UCCCAGAGGUCUACCCAGANN | 3381 | UCUGGGUAGACCUCUGGGANN | 3382 |
| NM_005080_737-755 | CCCAGAGGUCUACCCAGAANN | 3383 | UUCUGGGUAGACCUCUGGGNN | 3384 |
| NM_005080_738-756 | CCAGAGGUCUACCCAGAAGNN | 3385 | CUUCGGGUAGACCUCUGGNN | 3386 |
| NM_005080_740-758 | AGAGGUCUACCCAGAAGGANN | 3387 | UCCUUCUGGGUAGACCUCNN | 3388 |
| NM_005080_741-759 | GAGGUCUACCCAGAAGGACNN | 3389 | GUCCUUCUGGGUAGACCUCNN | 3390 |
| NM_005080_742-760 | AGGUCUACCCAGAAGGACCNN | 3391 | GGUCCUUCUGGGUAGACCUNN | 3392 |
| NM_005080_743-761 | GGUCUACCCAGAAGGACCCNN | 3393 | GGGUCCUUCUGGGUAGACCNN | 3394 |
| NM_005080_748-766 | ACCCAGAAGGACCCAGUUCNN | 3395 | GAACUGGGUCCUUCUGGGUNN | 3396 |
| NM_005080_749-767 | CCCAGAAGGACCCAGUUCCNN | 3397 | GGAACUGGGUCCUUCUGGGNN | 3398 |
| NM_005080_750-768 | CCAGAAGGACCCAGUUCCUNN | 3399 | AGGAACUGGGUCCUUCUGGNN | 3400 |
| NM_005080_751-769 | CAGAAGGACCCAGUUCCUUNN | 3401 | AAGGAACUGGGUCCUUCUGNN | 3402 |
| NM_005080_752-770 | AGAAGGACCCAGUUCCUUANN | 3403 | UAAGGAACUGGGUCCUUCUNN | 3404 |
| NM_005080_756-774 | GGACCCAGUUCCUUACCAGNN | 3405 | CUGGUAAGGAACUGGGUCCNN | 3406 |
| NM_005080_758-776 | ACCCAGUUCCUUACCAGCCNN | 3407 | GGCUGGUAAGGAACUGGGUNN | 3408 |
| NM_005080_759-777 | CCCAGUUCCUUACCAGCCUNN | 3409 | AGGCUGGUAAGGAACUGGGNN | 3410 |
| NM_005080_760-778 | CCAGUUCCUUACCAGCCUCNN | 3411 | GAGGCUGGUAAGGAACUGGNN | 3412 |
| NM_005080_761-779 | CAGUUCCUUACCAGCCUCCNN | 3413 | GGAGGCUGGUAAGGAACUGNN | 3414 |
| NM_005080_762-780 | AGUUCCUUACCAGCCUCCCNN | 3415 | GGGAGGCUGGUAAGGAACUNN | 3416 |
| NM_005080_767-785 | CUUACCAGCCUCCCUUUCUNN | 3417 | AGAAAGGGAGGCUGGUAAGNN | 3418 |
| NM_005080_769-787 | UACCAGCCUCCCUUUCUCUNN | 3419 | AGAGAAAGGGAGGCUGGUANN | 3420 |
| NM_005080_773-791 | AGCCUCCCUUUCUCUGUCANN | 3421 | UGACAGAGAAAGGGAGGCUNN | 3422 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_779-797 | CCUUUCUCUGUCAGUGGGGNN | 3423 | CCCCACUGACAGAGAAAGGNN | 3424 |
| NM_005080_786-804 | CUGUCAGUGGGGACGUCAUNN | 3425 | AUGACGUCCCCACUGACAGNN | 3426 |
| NM_005080_787-805 | UGUCAGUGGGGACGUCAUCNN | 3427 | GAUGACGUCCCCACUGACANN | 3428 |
| NM_005080_789-807 | UCAGUGGGGACGUCAUCAGNN | 3429 | CUGAUGACGUCCCCACUGANN | 3430 |
| NM_005080_793-811 | UGGGGACGUCAUCAGCCAANN | 3431 | UUGGCUGAUGACGUCCCCANN | 3432 |
| NM_005080_795-813 | GGGACGUCAUCAGCCAAGCNN | 3433 | GCUUGGCUGAUGACGUCCCNN | 3434 |
| NM_005080_797-815 | GACGUCAUCAGCCAAGCUGNN | 3435 | CAGCUUGGCUGAUGACGUCNN | 3436 |
| NM_005080_798-816 | ACGUCAUCAGCCAAGCUGGNN | 3437 | CCAGCUUGGCUGAUGACGUNN | 3438 |
| NM_005080_800-818 | GUCAUCAGCCAAGCUGGAANN | 3439 | UUCCAGCUUGGCUGAUGACNN | 3440 |
| NM_005080_804-822 | UCAGCCAAGCUGGAAGCCANN | 3441 | UGGCUUCCAGCUUGGCUGANN | 3442 |
| NM_005080_806-824 | AGCCAAGCUGGAAGCCAUUNN | 3443 | AAUGGCUUCCAGCUUGGCUNN | 3444 |
| NM_005080_807-825 | GCCAAGCUGGAAGCCAUUANN | 3445 | UAAUGGCUUCCAGCUUGGCNN | 3446 |
| NM_005080_808-826 | CCAAGCUGGAAGCCAUUAANN | 3447 | UUAAUGGCUUCCAGCUUGGNN | 3448 |
| NM_005080_809-827 | CAAGCUGGAAGCCAUUAAUNN | 3449 | AUUAAUGGCUUCCAGCUUGNN | 3450 |
| NM_005080_810-828 | AAGCUGGAAGCCAUUAAUGNN | 3451 | CAUUAAUGGCUUCCAGCUUNN | 3452 |
| NM_005080_811-829 | AGCUGGAAGCCAUUAAUGANN | 3453 | UCAUUAAUGGCUUCCAGCUNN | 3454 |
| NM_005080_813-831 | CUGGAAGCCAUUAAUGAACNN | 3455 | GUUCAUUAAUGGCUUCCAGNN | 3456 |
| NM_005080_814-832 | UGGAAGCCAUUAAUGAACUNN | 3457 | AGUUCAUUAAUGGCUUCCANN | 3458 |
| NM_005080_818-836 | AGCCAUUAAUGAACUAAUUNN | 3459 | AAUUAGUUCAUUAAUGGCUNN | 3460 |
| NM_005080_820-838 | CCAUUAAUGAACUAAUUCGNN | 3461 | CGAAUUAGUUCAUUAAUGGNN | 3462 |
| NM_005080_837-855 | CGUUUUGACCACAUAUAUANN | 3463 | UAUAUAUGUGGUCAAAACGNN | 3464 |
| NM_005080_844-862 | ACCACAUAUAUACCAAGCCNN | 3465 | GGCUUGGUAUAUAUGUGGUNN | 3466 |
| NM_005080_872-890 | AGAGAUACCCUCUGAGACANN | 3467 | UGUCUCAGAGGGUAUCUCUNN | 3468 |
| NM_005080_873-891 | GAGAUACCCUCUGAGACAGNN | 3469 | CUGUCUCAGAGGGUAUCUCNN | 3470 |
| NM_005080_874-892 | AGAUACCCUCUGAGACAGANN | 3471 | UCUGUCUCAGAGGGUAUCUNN | 3472 |
| NM_005080_876-894 | AUACCCUCUGAGACAGAGANN | 3473 | UCUCUGUCUCAGAGGGUAUNN | 3474 |
| NM_005080_889-907 | CAGAGAGCCAAGCUAAUGUNN | 3475 | ACAUUAGCUUGGCUCUCUGNN | 3476 |
| NM_005080_890-908 | AGAGAGCCAAGCUAAUGUGNN | 3477 | CACAUUAGCUUGGCUCUCUNN | 3478 |
| NM_005080_897-915 | CAAGCUAAUGUGGUAGUGANN | 3479 | UCACUACCACAUUAGCUUGNN | 3480 |
| NM_005080_898-916 | AAGCUAAUGUGGUAGUGAANN | 3481 | UUCACUACCACAUUAGCUUNN | 3482 |
| NM_005080_901-919 | CUAAUGUGGUAGUGAAAAUNN | 3483 | AUUUUCACUACCACAUUAGNN | 3484 |
| NM_005080_903-921 | AAUGUGGUAGUGAAAAUCGNN | 3485 | CGAUUUUCACUACCACAUUNN | 3486 |
| NM_005080_904-922 | AUGUGGUAGUGAAAAUCGANN | 3487 | UCGAUUUUCACUACCACAUNN | 3488 |
| NM_005080_906-924 | GUGGUAGUGAAAAUCGAGGNN | 3489 | CCUCGAUUUUCACUACCACNN | 3490 |
| NM_005080_907-925 | UGGUAGUGAAAAUCGAGGANN | 3491 | UCCUCGAUUUUCACUACCANN | 3492 |
| NM_005080_910-928 | UAGUGAAAAUCGAGGAAGCNN | 3493 | GCUUCCUCGAUUUUCACUANN | 3494 |
| NM_005080_913-931 | UGAAAAUCGAGGAAGCACCNN | 3495 | GGUGCUUCCUCGAUUUUCANN | 3496 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_916-934 | AAAUCGAGGAAGCACCUCUCNN | 3497 | AGAGGUGCUUCCUCGAUUUNN | 3498 |
| NM_005080_918-936 | AUCGAGGAAGCACCUCUCANN | 3499 | UGAGAGGUGCUUCCUCGAUNN | 3500 |
| NM_005080_919-937 | UCGAGGAAGCACCUCUCAGNN | 3501 | CUGAGAGGUGCUUCCUCGANN | 3502 |
| NM_005080_920-938 | CGAGGAAGCACCUCUCAGCNN | 3503 | GCUGAGAGGUGCUUCCUCGNN | 3504 |
| NM_005080_922-940 | AGGAAGCACCUCUCAGCCCNN | 3505 | GGGCUGAGAGGUGCUUCCUNN | 3506 |
| NM_005080_923-941 | GGAAGCACCUCUCAGCCCCNN | 3507 | GGGGCUGAGAGGUGCUUCCNN | 3508 |
| NM_005080_929-947 | ACCUCUCAGCCCCUCAGAGNN | 3509 | CUCUGAGGGGCUGAGAGGUNN | 3510 |
| NM_005080_930-948 | CCUCUCAGCCCCUCAGAGANN | 3511 | UCUCUGAGGGGCUGAGAGGNN | 3512 |
| NM_005080_931-949 | CUCUCAGCCCCUCAGAGAANN | 3513 | UUCUCUGAGGGGCUGAGAGNN | 3514 |
| NM_005080_932-950 | UCUCAGCCCCUCAGAGAAUNN | 3515 | AUUCUCUGAGGGGCUGAGANN | 3516 |
| NM_005080_933-951 | CUCAGCCCCUCAGAGAAUGNN | 3517 | CAUUCUCUGAGGGGCUGAGNN | 3518 |
| NM_005080_934-952 | UCAGCCCCUCAGAGAAUGANN | 3519 | UCAUUCUCUGAGGGGCUGANN | 3520 |
| NM_005080_935-953 | CAGCCCCUCAGAGAAUGAUNN | 3521 | AUCAUUCUCUGAGGGGCUGNN | 3522 |
| NM_005080_936-954 | AGCCCCUCAGAGAAUGAUCNN | 3523 | GAUCAUUCUCUGAGGGGCUNN | 3524 |
| NM_005080_938-956 | CCCCUCAGAGAAUGAUCACNN | 3525 | GUGAUCAUUCUCUGAGGGGNN | 3526 |
| NM_005080_941-959 | CUCAGAGAAUGAUCACCCUNN | 3527 | AGGGUGAUCAUUCUCUGAGNN | 3528 |
| NM_005080_942-960 | UCAGAGAAUGAUCACCCUGNN | 3529 | CAGGGUGAUCAUUCUCUGANN | 3530 |
| NM_005080_943-961 | CAGAGAAUGAUCACCCUGANN | 3531 | UCAGGGUGAUCAUUCUCUGNN | 3532 |
| NM_005080_944-962 | AGAGAAUGAUCACCCUGAANN | 3533 | UUCAGGGUGAUCAUUCUCUNN | 3534 |
| NM_005080_946-964 | AGAAUGAUCACCCUGAAUUNN | 3535 | AAUUCAGGGUGAUCAUUCUNN | 3536 |
| NM_005080_947-965 | GAAUGAUCACCCUGAAUUCNN | 3537 | GAAUUCAGGGUGAUCAUUCNN | 3538 |
| NM_005080_948-966 | AAUGAUCACCCUGAAUUCANN | 3539 | UGAAUUCAGGGUGAUCAUUNN | 3540 |
| NM_005080_949-967 | AUGAUCACCCUGAAUUCAUNN | 3541 | AUGAAUUCAGGGUGAUCAUNN | 3542 |
| NM_005080_955-973 | ACCCUGAAUUCAUUGUCUCNN | 3543 | GAGACAAUGAAUUCAGGGUNN | 3544 |
| NM_005080_956-974 | CCCUGAAUUCAUUGUCUCANN | 3545 | UGAGACAAUGAAUUCAGGGNN | 3546 |
| NM_005080_957-975 | CCUGAAUUCAUUGUCUCAGNN | 3547 | CUGAGACAAUGAAUUCAGGNN | 3548 |
| NM_005080_960-978 | GAAUUCAUUGUCUCAGUGANN | 3549 | UCACUGAGACAAUGAAUUCNN | 3550 |
| NM_005080_961-979 | AAUUCAUUGUCUCAGUGAANN | 3551 | UUCACUGAGACAAUGAAUUNN | 3552 |
| NM_005080_965-983 | CAUUGUCUCAGUGAAGGAANN | 3553 | UUCCUUCACUGAGACAAUGNN | 3554 |
| NM_005080_967-985 | UUGUCUCAGUGAAGGAAGANN | 3555 | UCUUCCUUCACUGAGACAANN | 3556 |
| NM_005080_968-986 | UGUCUCAGUGAAGGAAGAANN | 3557 | UUCUUCCUUCACUGAGACANN | 3558 |
| NM_005080_971-989 | CUCAGUGAAGGAAGAACCUNN | 3559 | AGGUUCUUCCUUCACUGAGNN | 3560 |
| NM_005080_972-990 | UCAGUGAAGGAAGAACCUGNN | 3561 | CAGGUUCUUCCUUCACUGANN | 3562 |
| NM_005080_973-991 | CAGUGAAGGAAGAACCUGUNN | 3563 | ACAGGUUCUUCCUUCACUGNN | 3564 |
| NM_005080_980-998 | GGAAGAACCUGUAGAAGAUNN | 3565 | AUCUUCUACAGGUUCUUCCNN | 3566 |
| NM_005080_984-1002 | GAACCUGUAGAAGAUGACCNN | 3567 | GGUCAUCUUCUACAGGUUCNN | 3568 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_986-1004 | ACCUGUAGAAGAUGACCUCNN | 3569 | GAGGUCAUCUUCUACAGGUNN | 3570 |
| NM_005080_1023-1041 | UCAAAUCUGCUUUCAUCCANN | 3571 | UGGAUGAAAGCAGAUUUGANN | 3572 |
| NM_005080_1151-1169 | UUCUUGGGAGGACACUUUUNN | 3573 | AAAAGUGUCCUCCCAAGAANN | 3574 |
| NM_005080_1367-1385 | UCUUUUGACAUCCAGCAGUNN | 3575 | ACUGCUGGAUGUCAAAAGANN | 3576 |
| NM_005080_1414-1432 | UAAGAAAUAUUACUAUAAUNN | 3577 | AUUAUAGUAAUAUUUCUUANN | 3578 |
| NM_005080_1415-1433 | AAGAAAUAUUACUAUAAUUNN | 3579 | AAUUAUAGUAAUAUUUCUUNN | 3580 |
| NM_005080_1674-1692 | ACUUCAAGUAAGAUCAAGANN | 3581 | UCUUGAUCUUACUUGAAGUNN | 3582 |
| NM_005080_1675-1693 | CUUCAAGUAAGAUCAAGAANN | 3583 | UUCUUGAUCUUACUUGAAGNN | 3584 |
| NM_005080_330-348 | AAUGAGUGAGCUGGAACAGNN | 3585 | CUGUUCCAGCUCACUCAUNN | 3586 |
| NM_005080_333-351 | GAGUGAGCUGGAACAGCAANN | 3587 | UUGCUGUUCCAGCUCACUCNN | 3588 |
| NM_005080_592-610 | CCCCUCCAGAACAUCUCCCNN | 3589 | GGGAGAUGUUCUGGAGGGGNN | 3590 |
| NM_005080_665-683 | CAUUCUGGACAACUUGGACNN | 3591 | GUCCAAGUUGUCCAGAAUGNN | 3592 |
| NM_005080_815-833 | GGAAGCCAUUAAUGAACUANN | 3593 | UAGUUCAUUAAUGGCUUCCNN | 3594 |
| NM_005080_1029-1047 | CUGCUUUCAUCCAGCCACUNN | 3595 | AGUGGCUGGAUGAAAGCAGNN | 3596 |
| NM_005080_1077-1095 | GCUUACAGUGACUGUGGAUNN | 3597 | AUCCACAGUCACUGUAAGCNN | 3598 |
| NM_005080_1222-1240 | GUUGCCCUUUUCCUUGACUNN | 3599 | AGUCAAGGAAAAGGGCAACNN | 3600 |
| NM_005080_1285-1303 | UUCAAAAAGCCAAAAUAGANN | 3601 | UCUAUUUUGGCUUUUUGAANN | 3602 |
| NM_005080_1334-1352 | UGUUCAGAUCUCAUAGAUGNN | 3603 | CAUCUAUGAGAUCUGAACANN | 3604 |
| NM_005080_1335-1353 | GUUCAGAUCUCAUAGAUGANN | 3605 | UCAUCUAUGAGAUCUGAACNN | 3606 |
| NM_005080_1436-1454 | GAACUACAGCUUUUAAGAUNN | 3607 | AUCUUAAAAGCUGUAGUUCNN | 3608 |
| NM_005080_1449-1467 | UAAGAUUGUACUUUUAUCUNN | 3609 | AGAUAAAAGUACAAUCUUANN | 3610 |
| NM_005080_1450-1468 | AAGAUUGUACUUUUAUCUUNN | 3611 | AAGAUAAAAGUACAAUCUUNN | 3612 |
| NM_005080_114-132 | GCAGCCCGCCUCCGCCGCCNN | 3613 | GGCGGCGGAGGCGGGCUGCNN | 3614 |
| NM_005080_1555-1573 | UUCUUUAUCAUUUCUCUUCNN | 3615 | GAAGAGAAAUGAUAAAGAANN | 3616 |
| NM_005080_1556-1574 | UCUUUAUCAUUUCUCUUCCNN | 3617 | GGAAGAGAAAUGAUAAAGANN | 3618 |
| NM_005080_1561-1579 | AUCAUUUCUCUUCCCCCUUNN | 3619 | AAGGGGGAAGAGAAAUGAUNN | 3620 |
| NM_005080_1562-1580 | UCAUUUCUCUUCCCCCUUUNN | 3621 | AAAGGGGGAAGAGAAAUGANN | 3622 |
| NM_005080_1569-1587 | UCUUCCCCCUUUUUGGCAUNN | 3623 | AUGCCAAAAGGGGGAAGANN | 3624 |
| NM_005080_1588-1606 | CCUGGCUUGCCUCCAGUUUNN | 3625 | AAACUGGAGGCAAGCCAGGNN | 3626 |
| NM_005080_1640-1658 | AACACCUGCUGAGGGGGCUNN | 3627 | AGCCCCCUCAGCAGGUGUUNN | 3628 |
| NM_005080_1641-1659 | ACACCUGCUGAGGGGGCUCNN | 3629 | GAGCCCCCUCAGCAGGUGUNN | 3630 |
| NM_005080_1642-1660 | CACCUGCUGAGGGGGCUCUNN | 3631 | AGAGCCCCCUCAGCAGGUGNN | 3632 |
| NM_005080_1650-1668 | GAGGGGGCUCUUUCCCUCANN | 3633 | UGAGGGAAAGAGCCCCCUCNN | 3634 |
| NM_005080_1686-1704 | AUCAAGAAUCUUUUGUGAANN | 3635 | UUCACAAAAGAUUCUUGAUNN | 3636 |
| NM_005080_1745-1763 | UCCUGCUAGUGUAGCUUCUNN | 3637 | AGAAGCUACACUAGCAGGANN | 3638 |
| NM_005080_138-156 | CCCGGCCGGCCAGGCCCUGNN | 3639 | CAGGGCCUGGCCGGCCGGGNN | 3640 |
| NM_005080_145-163 | GGCCAGGCCCUGCCGCUCANN | 3641 | UGAGCGGCAGGGCCUGGCCNN | 3642 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_190-208 | CCGGAGGCAGCGAGCGGGGNN | 3643 | CCCCGCTCGCTGCCTCCGGNN | 3644 |
| NM_005080_191-209 | CGGAGGCAGCGAGCGGGGGNN | 3645 | CCCCCGCTCGCTGCCTCCGNN | 3646 |
| NM_005080_192-210 | GGAGGCAGCGAGCGGGGGGNN | 3647 | CCCCCCGCTCGCTGCCTCCNN | 3648 |
| NM_005080_259-277 | GAGAAGGCGCUGAGGAGGANN | 3649 | UCCUCCUCAGCGCCUUCUCNN | 3650 |
| NM_005080_261-279 | GAAGGCGCUGAGGAGGAAANN | 3651 | UUUCCUCCUCAGCGCCUUCNN | 3652 |
| NM_005080_289-307 | AGAGUAGCAGCUCAGACUGNN | 3653 | CAGUCUGAGCUGCUACUCUNN | 3654 |
| NM_005080_363-381 | AGAAGAAGAGAACCAAAAANN | 3655 | TTTTTGGTTCTCTTCTTCTNN | 3656 |
| NM_005080_365-383 | AAGAAGAGAACCAAAAACUNN | 3657 | AGUUUUUGGUUCUCUUCUUNN | 3658 |
| NM_005080_385-403 | UUGCUAGAAAAUCAGCUUUNN | 3659 | AAAGCUGAUUUUCUAGCAANN | 3660 |
| NM_005080_461-479 | GGAUGGAUGCCCUGGUUGCNN | 3661 | GCAACCAGGGCAUCCAUCCNN | 3662 |
| NM_005080_490-508 | GCGGAAGCCAAGGGGAAUGNN | 3663 | CAUUCCCCUUGGCUUCCGCNN | 3664 |
| NM_005080_518-536 | CAGUGGCCGGGUCUGCUGANN | 3665 | UCAGCAGACCCGGCCACUGNN | 3666 |
| NM_005080_673-691 | ACAACUUGGACCCAGUCAUNN | 3667 | AUGACUGGGUCCAAGUUGUNN | 3668 |
| NM_005080_685-703 | CAGUCAUGUUCUUCAAAUGNN | 3669 | CAUUUGAAGAACAUGACUGNN | 3670 |
| NM_005080_730-748 | AGGAGCUCCCAGAGGUCUANN | 3671 | UAGACCUCUGGGAGCUCCUNN | 3672 |
| NM_005080_772-790 | CAGCCCUCCCUUUCUCUGUCNN | 3673 | GACAGAGAAAGGGAGGCUGNN | 3674 |
| NM_005080_801-819 | UCAUCAGCCAAGCUGGAAGNN | 3675 | CUUCCAGCUUGGCUGAUGANN | 3676 |
| NM_005080_817-835 | AAGCCAUUAAUGAACUAAUNN | 3677 | AUUAGUUCAUUAAUGGCUUNN | 3678 |
| NM_005080_887-905 | GACAGAGAGCCAAGCUAAUNN | 3679 | AUUAGCUUGGCUCUCUGUCNN | 3680 |
| NM_005080_924-942 | GAAGCACCUCUCAGCCCCUNN | 3681 | AGGGGCUGAGAGGUGCUUCNN | 3682 |
| NM_005080_927-945 | GCACCUCUCAGCCCCUCAGNN | 3683 | CUGAGGGGCUGAGAGGUGCNN | 3684 |
| NM_005080_928-946 | CACCUCUCAGCCCCUCAGANN | 3685 | UCUGAGGGGCUGAGAGGUGNN | 3686 |
| NM_005080_974-992 | AGUGAAGGAAGAACCUGUANN | 3687 | UACAGGUUCUUCCUUCACUNN | 3688 |
| NM_005080_985-1003 | AACCUGUAGAAGAUGACCUNN | 3689 | AGGUCAUCUUCUACAGGUUNN | 3690 |
| NM_005080_187-205 | AGCCCGGAGGCAGCGAGCGNN | 3691 | CGCTCGCTGCCTCCGGGCTNN | 3692 |
| NM_005080_672-690 | GACAACUUGGACCCAGUCANN | 3693 | UGACUGGGUCCAAGUUGUCNN | 3694 |
| NM_005080_771-789 | CCAGCCCUCCCUUUCUCUGUNN | 3695 | ACAGAGAAAGGGAGGCUGGNN | 3696 |
| NM_005080_1740-1758 | UUUUUUCCUGCUAGUGUAGNN | 3697 | CUACACUAGCAGGAAAAAANN | 3698 |
| NM_005080_1741-1759 | UUUUUCCUGCUAGUGUAGCNN | 3699 | GCUACACUAGCAGGAAAAANN | 3700 |
| NM_005080_662-680 | GGGCAUUCUGGACAACUUGNN | 3701 | CAAGUUGUCCAGAAUGCCCNN | 3702 |
| NM_005080_1070-1088 | ACUGGAUGCUUACAGUGACNN | 3703 | GUCACUGUAAGCAUCCAGUNN | 3704 |
| NM_005080_631-649 | ACUCUUCAGAUUCAGAGUCNN | 3705 | GACUCUGAAUCUGAAGAGUNN | 3706 |
| NM_005080_647-665 | GUCUGAUAUCCUGUUGGGCNN | 3707 | GCCCAACAGGAUAUCAGACNN | 3708 |
| NM_005080_791-809 | AGUGGGGACGUCAUCAGCCNN | 3709 | GGCUGAUGACGUCCCCACUNN | 3710 |
| NM_005080_981-999 | GAAGAACCUGUAGAAGAUGNN | 3711 | CAUCUUCUACAGGUUCUUCNN | 3712 |
| NM_005080_1068-1086 | CUACUGGAUGCUUACAGUGNN | 3713 | CACUGUAAGCAUCCAGUAGNN | 3714 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_1391-1409 | GUAUUGAGACAUAUUACUGNN | 3715 | CAGUAAUAUGUCUCAAUACNN | 3716 |
| NM_005080_1426-1444 | CUAUAAUUGAGAACUACAGNN | 3717 | CUGUAGUUCUCAAUUAUAGNN | 3718 |
| NM_005080_103-121 | CUUCUGUCGGGGCAGCCCGNN | 3719 | CGGGCUGCCCCGACAGAAGNN | 3720 |
| NM_005080_1457-1475 | UACUUUUAUCUUAAAAGGGNN | 3721 | CCCUUUUAAGAUAAAAGUANN | 3722 |
| NM_005080_1568-1586 | CUCUUCCCCCUUUUUGGCANN | 3723 | UGCCAAAAAGGGGGAAGAGNN | 3724 |
| NM_005080_1574-1592 | CCCCUUUUUGGCAUCCUGGNN | 3725 | CCAGGAUGCCAAAAAGGGGNN | 3726 |
| NM_005080_1577-1595 | CUUUUUGGCAUCCUGGCUUNN | 3727 | AAGCCAGGAUGCCAAAAAGNN | 3728 |
| NM_005080_1730-1748 | CUUGAUGGAAUUUUUUCCUNN | 3729 | AGGAAAAAAUUCCAUCAAGNN | 3730 |
| NM_005080_1731-1749 | UUGAUGGAAUUUUUUCCUGNN | 3731 | CAGGAAAAAAUUCCAUCAANN | 3732 |
| NM_005080_1732-1750 | UGAUGGAAUUUUUUCCUGCNN | 3733 | GCAGGAAAAAAUUCCAUCANN | 3734 |
| NM_005080_293-311 | UAGCAGCUCAGACUGCCAGNN | 3735 | CUGGCAGUCUGAGCUGCUANN | 3736 |
| NM_005080_350-368 | AAGUGGUAGAUUUAGAAGANN | 3737 | UCUUCUAAAUCUACCACUUNN | 3738 |
| NM_005080_351-369 | AGUGGUAGAUUUAGAAGAANN | 3739 | UUCUUCUAAAUCUACCACUNN | 3740 |
| NM_005080_630-648 | GACUCUUCAGAUUCAGAGUNN | 3741 | ACUCUGAAUCUGAAGAGUCNN | 3742 |
| NM_005080_657-675 | CUGUUGGGCAUUCUGGACANN | 3743 | UGUCCAGAAUGCCCAACAGNN | 3744 |
| NM_005080_670-688 | UGGACAACUUGGACCCAGUNN | 3745 | ACUGGGUCCAAGUUGUCCANN | 3746 |
| NM_005080_692-710 | GUUCUUCAAAUGCCCUUCCNN | 3747 | GGAAGGGCAUUUGAAGAACNN | 3748 |
| NM_005080_778-796 | CCCUUUCUCUGUCAGUGGGNN | 3749 | CCCACUGACAGAGAAAGGGNN | 3750 |
| NM_005080_790-808 | CAGUGGGGACGUCAUCAGCNN | 3751 | GCUGAUGACGUCCCCACUGNN | 3752 |
| NM_005080_970-988 | UCUCAGUGAAGGAAGAACCNN | 3753 | GGUUCUUCCUUCACUGAGANN | 3754 |
| NM_005080_1162-1180 | ACACUUUUGCCAAUGAACUNN | 3755 | AGUUCAUUGGCAAAAGUGUNN | 3756 |
| NM_005080_1368-1386 | CUUUUGACAUCCAGCAGUCNN | 3757 | GACUGCUGGAUGUCAAAAGNN | 3758 |
| NM_005080_1515-1533 | UAGACAAAUGUCUUGAAGUNN | 3759 | ACUUCAAGACAUUUGUCUANN | 3760 |
| NM_005080_1541-1559 | GAAUUUAUGAAUGGUUCUUNN | 3761 | AAGAACCAUUCAUAAAUUCNN | 3762 |
| NM_005080_1542-1560 | AAUUUAUGAAUGGUUCUUUNN | 3763 | AAAGAACCAUUCAUAAAUUNN | 3764 |
| NM_005080_1571-1589 | UUCCCCCUUUUUGGCAUCCNN | 3765 | GGAUGCCAAAAAGGGGGAANN | 3766 |
| NM_005080_151-169 | GCCCUGCCGCUCAUGGUGCNN | 3767 | GCACCAUGAGCGGCAGGGCNN | 3768 |
| NM_005080_160-178 | CUCAUGGUGCCAGCCCAGANN | 3769 | UCUGGGCUGGCACCAUGAGNN | 3770 |
| NM_005080_326-344 | CUCGAAUGAGUGAGCUGGANN | 3771 | UCCAGCUCACUCAUUCGAGNN | 3772 |
| NM_005080_327-345 | UCGAAUGAGUGAGCUGGAANN | 3773 | UUCCAGCUCACUCAUUCGANN | 3774 |
| NM_005080_331-349 | AUGAGUGAGCUGGAACAGCNN | 3775 | GCUGUUCCAGCUCACUCAUNN | 3776 |
| NM_005080_424-442 | CUUGUAGUUGAGAACCAGGNN | 3777 | CCUGGUUCUCAACUACAAGNN | 3778 |
| NM_005080_483-501 | AGAGGAGGCGGAAGCCAAGNN | 3779 | CTTGGCTTCCGCCTCCTCTNN | 3780 |
| NM_005080_579-597 | GGCCCAGUUGUCACCCCUCNN | 3781 | GAGGGGUGACAACUGGGCCNN | 3782 |
| NM_005080_745-763 | UCUACCCAGAAGGACCCAGNN | 3783 | CUGGGUCCUUCUGGGUAGANN | 3784 |
| NM_005080_746-764 | CUACCCAGAAGGACCCAGUNN | 3785 | ACUGGGUCCUUCUGGGUAGNN | 3786 |
| NM_005080_812-830 | GCUGGAAGCCAUUAAUGAANN | 3787 | UUCAUUAAUGGCUUCCAGCNN | 3788 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_871-889 | UAGAGAUACCCUCUGAGACNN | 3789 | GUCUCAGAGGGUAUCUCUANN | 3790 |
| NM_005080_892-910 | AGAGCCAAGCUAAUGUGGUNN | 3791 | ACCACAUUAGCUUGGCUCUNN | 3792 |
| NM_005080_978-996 | AAGGAAGAACCUGUAGAAGNN | 3793 | CUUCUACAGGUUCUUCCUUNN | 3794 |
| NM_005080_982-1000 | AAGAACCUGUAGAAGAUGANN | 3795 | UCAUCUUCUACAGGUUCUUNN | 3796 |
| NM_005080_257-275 | AGGAGAAGGCGCUGAGGAGNN | 3797 | CUCCUCAGCGCCUUCUCCUNN | 3798 |
| NM_005080_364-382 | GAAGAAGAGAACCAAAAACNN | 3799 | GUUUUUGGUUCUCUUCUUCNN | 3800 |
| NM_005080_816-834 | GAAGCCAUUAAUGAACUAANN | 3801 | UUAGUUCAUUAAUGGCUUCNN | 3802 |
| NM_005080_884-902 | UGAGACAGAGAGCCAAGCUNN | 3803 | AGCUUGGCUCUCUGUCUCANN | 3804 |
| NM_005080_925-943 | AAGCACCUCUCAGCCCCUCNN | 3805 | GAGGGGCUGAGAGGUGCUUNN | 3806 |
| NM_005080_1440-1458 | UACAGCUUUUAAGAUUGUANN | 3807 | UACAAUCUUAAAAGCUGUANN | 3808 |
| NM_005080_784-802 | CUCUGUCAGUGGGGACGUCNN | 3809 | GACGUCCCCACUGACAGAGNN | 3810 |
| NM_005080_1593-1611 | CUUGCCUCCAGUUUUAGGUNN | 3811 | ACCUAAAACUGGAGGCAAGNN | 3812 |
| NM_005080_301-319 | CAGACUGCCAGAGAUCGAANN | 3813 | UUCGAUCUCUGGCAGUCUGNN | 3814 |
| NM_005080_674-692 | CAACUUGGACCCAGUCAUGNN | 3815 | CAUGACUGGGUCCAAGUUGNN | 3816 |
| NM_005080_783-801 | UCUCUGUCAGUGGGGACGUNN | 3817 | ACGUCCCCACUGACAGAGANN | 3818 |
| NM_005080_921-939 | GAGGAAGCACCUCUCAGCCNN | 3819 | GGCUGAGAGGUGCUUCCUCNN | 3820 |
| NM_005080_1226-1244 | CCCUUUUCCUUGACUAUUANN | 3821 | UAAUAGUCAAGGAAAAGGGNN | 3822 |
| NM_005080_1283-1301 | CAUUCAAAAAGCCAAAAUANN | 3823 | UAUUUUGGCUUUUUGAAUGNN | 3824 |
| NM_005080_1416-1434 | AGAAAUAUUACUAUAAUUGNN | 3825 | CAAUUAUAGUAAUAUUUCUNN | 3826 |
| NM_005080_1420-1438 | AUAUUACUAUAAUUGAGAANN | 3827 | UUCUCAAUUAUAGUAAUAUNN | 3828 |
| NM_005080_1488-1506 | CUAAAAUACUUAUUAUGUANN | 3829 | UACAUAAUAAGUAUUUUAGNN | 3830 |
| NM_005080_1492-1510 | AAUACUUAUUAUGUAAGGGNN | 3831 | CCCUUACAUAAUAAGUAUUNN | 3832 |
| NM_005080_111-129 | GGGGCAGCCCGCCUCCGCCNN | 3833 | GGCGGAGGCGGGCUGCCCCNN | 3834 |
| NM_005080_1639-1657 | GAACACCUGCUGAGGGGGCNN | 3835 | GCCCCCUCAGCAGGUGUUCNN | 3836 |
| NM_005080_1685-1703 | GAUCAAGAAUCUUUUGUGANN | 3837 | UCACAAAAGAUUCUUGAUCNN | 3838 |
| NM_005080_1733-1751 | GAUGGAAUUUUUUCCUGCUNN | 3839 | AGCAGGAAAAAAUUCCAUCNN | 3840 |
| NM_005080_1734-1752 | AUGGAAUUUUUUCCUGCUANN | 3841 | UAGCAGGAAAAAAUUCCAUNN | 3842 |
| NM_005080_1737-1755 | GAAUUUUUUCCUGCUAGUGNN | 3843 | CACUAGCAGGAAAAAAUUCNN | 3844 |
| NM_005080_1756-1774 | UAGCUUCUGAAAGGUGCUUNN | 3845 | AAGCACCUUUCAGAAGCUANN | 3846 |
| NM_005080_1757-1775 | AGCUUCUGAAAGGUGCUUUNN | 3847 | AAAGCACCUUUCAGAAGCUNN | 3848 |
| NM_005080_152-170 | CCCUGCCGCUCAUGGUGCCNN | 3849 | GGCACCAUGAGCGGCAGGGNN | 3850 |
| NM_005080_153-171 | CCUGCCGCUCAUGGUGCCANN | 3851 | UGGCACCAUGAGCGGCAGGNN | 3852 |
| NM_005080_163-181 | AUGGUGCCAGCCCAGAGAGNN | 3853 | CUCUCUGGGCUGGCACCAUNN | 3854 |
| NM_005080_167-185 | UGCCAGCCCAGAGAGGGGCNN | 3855 | GCCCCUCUCUGGGCUGGCANN | 3856 |
| NM_005080_200-218 | CGAGCGGGGGCUGCCCCANN | 3857 | UGGGGCAGCCCCCCGCUCGNN | 3858 |
| NM_005080_252-270 | CCCCGAGGAGAAGGCGCUGNN | 3859 | CAGCGCCUUCUCCUCGGGGNN | 3860 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_255-273 | CGAGGAGAAGGCGCUGAGGNN | 3861 | CCUCAGCGCCUUCUCCUCGNN | 3862 |
| NM_005080_260-278 | AGAAGGCGCUGAGGAGGAANN | 3863 | UUCCUCCUCAGCGCCUUCUNN | 3864 |
| NM_005080_271-289 | AGGAGGAAACUGAAAAACANN | 3865 | UGUUUUUCAGUUUCCUCCUNN | 3866 |
| NM_005080_297-315 | AGCUCAGACUGCCAGAGAUNN | 3867 | AUCUCUGGCAGUCUGAGCUNN | 3868 |
| NM_005080_300-318 | UCAGACUGCCAGAGAUCGANN | 3869 | UCGAUCUCUGGCAGUCUGANN | 3870 |
| NM_005080_335-353 | GUGAGCUGGAACAGCAAGUNN | 3871 | ACUUGCUGUUCCAGCUCACNN | 3872 |
| NM_005080_368-386 | AAGAGAACCAAAAACUUUUNN | 3873 | AAAAGUUUUUGGUUCUCUUNN | 3874 |
| NM_005080_378-396 | AAAACUUUUGCUAGAAAAUNN | 3875 | AUUUUCUAGCAAAAGUUUUNN | 3876 |
| NM_005080_379-397 | AAACUUUUGCUAGAAAAUCNN | 3877 | GAUUUUCUAGCAAAAGUUUNN | 3878 |
| NM_005080_380-398 | AACUUUUGCUAGAAAAUCANN | 3879 | UGAUUUUCUAGCAAAAGUUNN | 3880 |
| NM_005080_389-407 | UAGAAAAUCAGCUUUUACGNN | 3881 | CGUAAAAGCUGAUUUUCUANN | 3882 |
| NM_005080_426-444 | UGUAGUUGAGAACCAGGAGNN | 3883 | CUCCUGGUUCUCAACUACANN | 3884 |
| NM_005080_427-445 | GUAGUUGAGAACCAGGAGUNN | 3885 | ACUCCUGGUUCUCAACUACNN | 3886 |
| NM_005080_485-503 | AGGAGGCGGAAGCCAAGGGNN | 3887 | CCCTTGGCTTCCGCCTCCTNN | 3888 |
| NM_005080_487-505 | GAGGCGGAAGCCAAGGGGANN | 3889 | TCCCCTTGGCTTCCGCCTCNN | 3890 |
| NM_005080_488-506 | AGGCGGAAGCCAAGGGGAANN | 3891 | TTCCCCTTGGCTTCCGCCTNN | 3892 |
| NM_005080_511-529 | GUGAGGCCAGUGGCCGGGUNN | 3893 | ACCCGGCCACUGGCCUCACNN | 3894 |
| NM_005080_526-544 | GGGUCUGCUGAGUCCGCAGNN | 3895 | CUGCGGACUCAGCAGACCCNN | 3896 |
| NM_005080_575-593 | UGCAGGCCCAGUUGUCACCNN | 3897 | GGUGACAACUGGGCCUGCANN | 3898 |
| NM_005080_593-611 | CCCUCCAGAACAUCUCCCCNN | 3899 | GGGGAGAUGUUCUGGAGGGNN | 3900 |
| NM_005080_595-613 | CUCCAGAACAUCUCCCCAUNN | 3901 | AUGGGGAGAUGUUCUGGAGNN | 3902 |
| NM_005080_654-672 | AUCCUGUUGGGCAUUCUGGNN | 3903 | CCAGAAUGCCCAACAGGAUNN | 3904 |
| NM_005080_675-693 | AACUUGGACCCAGUCAUGUNN | 3905 | ACAUGACUGGGUCCAAGUUNN | 3906 |
| NM_005080_683-701 | CCCAGUCAUGUUCUUCAAANN | 3907 | UUUGAAGAACAUGACUGGGNN | 3908 |
| NM_005080_684-702 | CCAGUCAUGUUCUUCAAAUNN | 3909 | AUUUGAAGAACAUGACUGGNN | 3910 |
| NM_005080_693-711 | UUCUUCAAAUGCCCUUCCCNN | 3911 | GGGAAGGGCAUUUGAAGAANN | 3912 |
| NM_005080_694-712 | UCUUCAAAUGCCCUUCCCCNN | 3913 | GGGGAAGGGCAUUUGAAGANN | 3914 |
| NM_005080_726-744 | CUGGAGGAGCUCCCAGAGGNN | 3915 | CCUCUGGGAGCUCCUCCAGNN | 3916 |
| NM_005080_744-762 | GUCUACCCAGAAGGACCCANN | 3917 | UGGGUCCUUCUGGGUAGACNN | 3918 |
| NM_005080_765-783 | UCCUUACCAGCCUCCCUUUNN | 3919 | AAAGGGAGGCUGGUAAGGANN | 3920 |
| NM_005080_768-786 | UUACCAGCCUCCCUUUCUCNN | 3921 | GAGAAAGGGAGGCUGGUAANN | 3922 |
| NM_005080_777-795 | UCCCUUUCUCUGUCAGUGGNN | 3923 | CCACUGACAGAGAAAGGGANN | 3924 |
| NM_005080_802-820 | CAUCAGCCAAGCUGGAAGCNN | 3925 | GCUUCCAGCUUGGCUGAUGNN | 3926 |
| NM_005080_877-895 | UACCCUCUGAGACAGAGAGNN | 3927 | CUCUCUGUCUCAGAGGGUANN | 3928 |
| NM_005080_878-896 | ACCCUCUGAGACAGAGAGCNN | 3929 | GCUCUCUGUCUCAGAGGGUNN | 3930 |
| NM_005080_885-903 | GAGACAGAGAGCCAAGCUANN | 3931 | UAGCUUGGCUCUCUGUCUCNN | 3932 |
| NM_005080_886-904 | AGACAGAGAGCCAAGCUAANN | 3933 | UUAGCUUGGCUCUCUGUCUNN | 3934 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_966-984 | AUUGUCUCAGUGAAGGAAGNN | 3935 | CUUCCUUCACUGAGACAAUNN | 3936 |
| NM_005080_969-987 | GUCUCAGUGAAGGAAGAACNN | 3937 | GUUCUUCCUUCACUGAGACNN | 3938 |
| NM_005080_1245-1263 | CACUGCCUGGAGGAUAGCANN | 3939 | UGCUAUCCUCCAGGCAGUGNN | 3940 |
| NM_005080_1738-1756 | AAUUUUUUCCUGCUAGUGUNN | 3941 | ACACUAGCAGGAAAAAAUUNN | 3942 |
| NM_005080_194-212 | AGGCAGCGAGCGGGGGGCUNN | 3943 | AGCCCCCCGCUCGCUGCCUNN | 3944 |
| NM_005080_209-227 | GGCUGCCCCAGGCGCGCAANN | 3945 | UUGCGCGCCUGGGGCAGCCNN | 3946 |
| NM_005080_269-287 | UGAGGAGGAAACUGAAAAANN | 3947 | UUUUUCAGUUUCCUCCUCANN | 3948 |
| NM_005080_902-920 | UAAUGUGGUAGUGAAAAUCNN | 3949 | GAUUUUCACUACCACAUUANN | 3950 |
| NM_005080_50-68 | UGGUGGUGGUGGCAGCCGCNN | 3951 | GCGGCUGCCACCACCACCANN | 3952 |
| NM_005080_1017-1035 | GGUAUCUCAAAUCUGCUUUNN | 3953 | AAAGCAGAUUUGAGAUACCNN | 3954 |
| NM_005080_1021-1039 | UCUCAAAUCUGCUUUCAUCNN | 3955 | GAUGAAAGCAGAUUUGAGANN | 3956 |
| NM_005080_1022-1040 | CUCAAAUCUGCUUUCAUCCNN | 3957 | GGAUGAAAGCAGAUUUGAGNN | 3958 |
| NM_005080_1062-1080 | UCCUGCCUACUGGAUGCUUNN | 3959 | AAGCAUCCAGUAGGCAGGANN | 3960 |
| NM_005080_1074-1092 | GAUGCUUACAGUGACUGUGNN | 3961 | CACAGUCACUGUAAGCAUCNN | 3962 |
| NM_005080_1116-1134 | UUCAGUGACAUGUCCUCUCNN | 3963 | GAGAGGACAUGUCACUGAANN | 3964 |
| NM_005080_1149-1167 | CAUUCUUGGGAGGACACUUNN | 3965 | AAGUGUCCUCCCAAGAAUGNN | 3966 |
| NM_005080_1150-1168 | AUUCUUGGGAGGACACUUUNN | 3967 | AAAGUGUCCUCCCAAGAAUNN | 3968 |
| NM_005080_1161-1179 | GACACUUUUGCCAAUGAACNN | 3969 | GUUCAUUGGCAAAAGUGUCNN | 3970 |
| NM_005080_1223-1241 | UUGCCCUUUUCCUUGACUANN | 3971 | UAGUCAAGGAAAAGGGCAANN | 3972 |
| NM_005080_1280-1298 | CUUCAUUCAAAAAGCCAAANN | 3973 | UUUGGCUUUUUGAAUGAAGNN | 3974 |
| NM_005080_1281-1299 | UUCAUUCAAAAAGCCAAAANN | 3975 | UUUUGGCUUUUUGAAUGAANN | 3976 |
| NM_005080_1284-1302 | AUUCAAAAAGCCAAAAUAGNN | 3977 | CUAUUUUGGCUUUUUGAAUNN | 3978 |
| NM_005080_1286-1304 | UCAAAAAGCCAAAAUAGAGNN | 3979 | CUCUAUUUUGGCUUUUUGANN | 3980 |
| NM_005080_1288-1306 | AAAAAGCCAAAAUAGAGAGNN | 3981 | CUCUCUAUUUUGGCUUUUUNN | 3982 |
| NM_005080_1365-1383 | UGUCUUUUGACAUCCAGCANN | 3983 | UGCUGGAUGUCAAAAGACANN | 3984 |
| NM_005080_1417-1435 | GAAAUAUUACUAUAAUUGANN | 3985 | UCAAUUAUAGUAAUAUUUCNN | 3986 |
| NM_005080_1421-1439 | UAUUACUAUAAUUGAGAACNN | 3987 | GUUCUCAAUUAUAGUAAUANN | 3988 |
| NM_005080_1434-1452 | GAGAACUACAGCUUUUAAGNN | 3989 | CUUAAAAGCUGUAGUUCUCNN | 3990 |
| NM_005080_1452-1470 | GAUUGUACUUUUAUCUUAANN | 3991 | UUAAGAUAAAAGUACAAUCNN | 3992 |
| NM_005080_105-123 | UCUGUCGGGGCAGCCCGCCNN | 3993 | GGCGGGCUGCCCCGACAGANN | 3994 |
| NM_005080_1455-1473 | UGUACUUUUAUCUUAAAAGNN | 3995 | CUUUUAAGAUAAAAGUACANN | 3996 |
| NM_005080_112-130 | GGGCAGCCCGCCUCCGCCGNN | 3997 | CGGCGGAGGCGGGCUGCCCNN | 3998 |
| NM_005080_113-131 | GGCAGCCCGCCUCCGCCGCNN | 3999 | GCGGCGGAGGCGGGCUGCCNN | 4000 |
| NM_005080_1543-1561 | AUUUAUGAAUGGUUCUUUANN | 4001 | UAAAGAACCAUUCAUAAAUNN | 4002 |
| NM_005080_1544-1562 | UUUAUGAAUGGUUCUUUAUNN | 4003 | AUAAAGAACCAUUCAUAAANN | 4004 |
| NM_005080_1557-1575 | CUUUAUCAUUUCUCUUCCCNN | 4005 | GGGAAGAGAAAUGAUAAAGNN | 4006 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_115-133 | CAGCCCGCCUCCGCCGCCGNN | 4007 | CGGCGGCGGAGGCGGGCUGNN | 4008 |
| NM_005080_1564-1582 | AUUUCUCUUCCCCCUUUUUNN | 4009 | AAAAAGGGGGAAGAGAAAUNN | 4010 |
| NM_005080_1572-1590 | UCCCCCUUUUUGGCAUCCUNN | 4011 | AGGAUGCCAAAAAGGGGGANN | 4012 |
| NM_005080_1575-1593 | CCCUUUUUGGCAUCCUGGCNN | 4013 | GCCAGGAUGCCAAAAAGGGNN | 4014 |
| NM_005080_1576-1594 | CCUUUUUGGCAUCCUGGCUNN | 4015 | AGCCAGGAUGCCAAAAAGGNN | 4016 |
| NM_005080_117-135 | GCCCGCCUCCGCCGCCGGANN | 4017 | UCCGGCGGCGGAGGCGGGCNN | 4018 |
| NM_005080_1582-1600 | UGGCAUCCUGGCUUGCCUCNN | 4019 | GAGGCAAGCCAGGAUGCCANN | 4020 |
| NM_005080_1587-1605 | UCCUGGCUUGCCUCCAGUUNN | 4021 | AACUGGAGGCAAGCCAGGANN | 4022 |
| NM_005080_118-136 | CCCGCCUCCGCCGCCGGAGNN | 4023 | CUCCGGCGGCGGAGGCGGGNN | 4024 |
| NM_005080_119-137 | CCGCCUCCGCCGCCGGAGCNN | 4025 | GCUCCGGCGGCGGAGGCGGNN | 4026 |
| NM_005080_120-138 | CGCCUCCGCCGCCGGAGCCNN | 4027 | GGCUCCGGCGGCGGAGGCGNN | 4028 |
| NM_005080_124-142 | UCCGCCGCCGGAGCCCCGGNN | 4029 | CCGGGGCUCCGGCGGCGGANN | 4030 |
| NM_005080_126-144 | CGCCGCCGGAGCCCCGGCCNN | 4031 | GGCCGGGGCUCCGGCGGCGNN | 4032 |
| NM_005080_1676-1694 | UUCAAGUAAGAUCAAGAAUNN | 4033 | AUUCUUGAUCUUACUUGAANN | 4034 |
| NM_005080_127-145 | GCCGCCGGAGCCCCGGCCGNN | 4035 | CGGCCGGGGCUCCGGCGGCNN | 4036 |
| NM_005080_129-147 | CGCCGGAGCCCCGGCCGGCNN | 4037 | GCCGGCCGGGGCUCCGGCGNN | 4038 |
| NM_005080_130-148 | GCCGGAGCCCCGGCCGGCCNN | 4039 | GGCCGGCCGGGGCUCCGGCNN | 4040 |
| NM_005080_131-149 | CCGGAGCCCCGGCCGGCCANN | 4041 | TGGCCGGCCGGGGCUCCGGNN | 4042 |
| NM_005080_1720-1738 | UAUGUAAAUGCUUGAUGGANN | 4043 | UCCAUCAAGCAUUUACAUANN | 4044 |
| NM_005080_1724-1742 | UAAAUGCUUGAUGGAAUUUNN | 4045 | AAAUUCCAUCAAGCAUUUANN | 4046 |
| NM_005080_132-150 | CGGAGCCCCGGCCGGCCAGNN | 4047 | CUGGCCGGCCGGGGCUCCGNN | 4048 |
| NM_005080_133-151 | GGAGCCCCGGCCGGCCAGGNN | 4049 | CCUGGCCGGCCGGGGCUCCNN | 4050 |
| NM_005080_134-152 | GAGCCCCGGCCGGCCAGGCNN | 4051 | GCCUGGCCGGCCGGGGCUCNN | 4052 |
| NM_005080_136-154 | GCCCCGGCCGGCCAGGCCCNN | 4053 | GGGCCUGGCCGGCCGGGGCNN | 4054 |
| NM_005080_1777-1795 | UCCAUUUAUUUAAAACUACNN | 4055 | GUAGUUUUAAAUAAAUGGANN | 4056 |
| NM_005080_137-155 | CCCCGGCCGGCCAGGCCCUNN | 4057 | AGGGCCUGGCCGGCCGGGGNN | 4058 |
| NM_005080_139-157 | CCGGCCGGCCAGGCCCUGCNN | 4059 | GCAGGGCCUGGCCGGCCGGNN | 4060 |
| NM_005080_140-158 | CGGCCGGCCAGGCCCUGCCNN | 4061 | GGCAGGGCCUGGCCGGCCGNN | 4062 |
| NM_005080_141-159 | GGCCGGCCAGGCCCUGCCGNN | 4063 | CGGCAGGGCCUGGCCGGCCNN | 4064 |
| NM_005080_142-160 | GCCGGCCAGGCCCUGCCGCNN | 4065 | GCGGCAGGGCCUGGCCGGCNN | 4066 |
| NM_005080_143-161 | CCGGCCAGGCCCUGCCGCUNN | 4067 | AGCGGCAGGGCCUGGCCGGNN | 4068 |
| NM_005080_144-162 | CGGCCAGGCCCUGCCGCUCNN | 4069 | GAGCGGCAGGGCCUGGCCGNN | 4070 |
| NM_005080_161-179 | UCAUGGUGCCAGCCCAGAGNN | 4071 | CUCUGGGCUGGCACCAUGANN | 4072 |
| NM_005080_162-180 | CAUGGUGCCAGCCCAGAGANN | 4073 | UCUCUGGGCUGGCACCAUGNN | 4074 |
| NM_005080_164-182 | UGGUGCCAGCCCAGAGAGGNN | 4075 | CCUCUCUGGGCUGGCACCANN | 4076 |
| NM_005080_165-183 | GGUGCCAGCCCAGAGAGGGNN | 4077 | CCCUCUCUGGGCUGGCACCNN | 4078 |
| NM_005080_166-184 | GUGCCAGCCCAGAGAGGGGNN | 4079 | CCCCUCUCUGGGCUGGCACNN | 4080 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_201-219 | GAGCGGGGGCUGCCCCAGNN | 4081 | CUGGGGCAGCCCCCCGCUCNN | 4082 |
| NM_005080_202-220 | AGCGGGGGCUGCCCCAGGNN | 4083 | CCUGGGGCAGCCCCCCGCUNN | 4084 |
| NM_005080_203-221 | GCGGGGGCUGCCCCAGGCNN | 4085 | GCCUGGGGCAGCCCCCCGCNN | 4086 |
| NM_005080_204-222 | CGGGGGGCUGCCCCAGGCGNN | 4087 | CGCCUGGGGCAGCCCCCCGNN | 4088 |
| NM_005080_208-226 | GGGCUGCCCCAGGCGCGCANN | 4089 | UGCGCGCCUGGGGCAGCCCNN | 4090 |
| NM_005080_212-230 | UGCCCCAGGCGCGCAAGCGNN | 4091 | CGCUUGCGCGCCUGGGGCANN | 4092 |
| NM_005080_248-266 | UGAGCCCCGAGGAGAAGGCNN | 4093 | GCCUUCUCCUCGGGGCUCANN | 4094 |
| NM_005080_251-269 | GCCCCGAGGAGAAGGCGCUNN | 4095 | AGCGCCUUCUCCUCGGGGCNN | 4096 |
| NM_005080_258-276 | GGAGAAGGCGCUGAGGAGGNN | 4097 | CCUCCUCAGCGCCUUCUCCNN | 4098 |
| NM_005080_262-280 | AAGGCGCUGAGGAGGAAACNN | 4099 | GUUUCCUCCUCAGCGCCUUNN | 4100 |
| NM_005080_265-283 | GCGCUGAGGAGGAAACUGANN | 4101 | UCAGUUUCCUCCUCAGCGCNN | 4102 |
| NM_005080_266-284 | CGCUGAGGAGGAAACUGAANN | 4103 | UUCAGUUUCCUCCUCAGCGNN | 4104 |
| NM_005080_267-285 | GCUGAGGAGGAAACUGAAANN | 4105 | UUUCAGUUUCCUCCUCAGCNN | 4106 |
| NM_005080_268-286 | CUGAGGAGGAAACUGAAAANN | 4107 | UUUUCAGUUUCCUCCUCAGNN | 4108 |
| NM_005080_270-288 | GAGGAGGAAACUGAAAAACNN | 4109 | GUUUUUCAGUUUCCUCCUCNN | 4110 |
| NM_005080_272-290 | GGAGGAAACUGAAAAACAGNN | 4111 | CUGUUUUUCAGUUUCCUCCNN | 4112 |
| NM_005080_273-291 | GAGGAAACUGAAAAACAGANN | 4113 | UCUGUUUUUCAGUUUCCUCNN | 4114 |
| NM_005080_277-295 | AAACUGAAAAACAGAGUAGNN | 4115 | CUACUCUGUUUUUCAGUUUNN | 4116 |
| NM_005080_328-346 | CGAAUGAGUGAGCUGGAACNN | 4117 | GUUCCAGCUCACUCAUUCGNN | 4118 |
| NM_005080_329-347 | GAAUGAGUGAGCUGGAACANN | 4119 | UGUUCCAGCUCACUCAUUCNN | 4120 |
| NM_005080_334-352 | AGUGAGCUGGAACAGCAAGNN | 4121 | CUUGCUGUUCCAGCUCACUNN | 4122 |
| NM_005080_336-354 | UGAGCUGGAACAGCAAGUGNN | 4123 | CACUUGCUGUUCCAGCUCANN | 4124 |
| NM_005080_337-355 | GAGCUGGAACAGCAAGUGGNN | 4125 | CCACUUGCUGUUCCAGCUCNN | 4126 |
| NM_005080_338-356 | AGCUGGAACAGCAAGUGGUNN | 4127 | ACCACUUGCUGUUCCAGCUNN | 4128 |
| NM_005080_356-374 | UAGAUUUAGAAGAAGAGAANN | 4129 | UUCUCUUCUUCUAAAUCUANN | 4130 |
| NM_005080_357-375 | AGAUUUAGAAGAAGAGAACNN | 4131 | GUUCUCUUCUUCUAAAUCUNN | 4132 |
| NM_005080_359-377 | AUUUAGAAGAAGAGAACCANN | 4133 | UGGUUCUCUUCUUCUAAAUNN | 4134 |
| NM_005080_360-378 | UUUAGAAGAAGAGAACCAANN | 4135 | UUGGUUCUCUUCUUCUAAANN | 4136 |
| NM_005080_362-380 | UAGAAGAAGAGAACCAAAANN | 4137 | UUUUGGUUCUCUUCUUCUANN | 4138 |
| NM_005080_367-385 | GAAGAGAACCAAAAACUUUNN | 4139 | AAAGUUUUUGGUUCUCUUCNN | 4140 |
| NM_005080_382-400 | CUUUUGCUAGAAAAUCAGCNN | 4141 | GCUGAUUUUCUAGCAAAAGNN | 4142 |
| NM_005080_386-404 | UGCUAGAAAAUCAGCUUUUNN | 4143 | AAAAGCUGAUUUUCUAGCANN | 4144 |
| NM_005080_401-419 | UUUUACGAGAGAAAACUCANN | 4145 | UGAGUUUUCUCUCGUAAAANN | 4146 |
| NM_005080_458-476 | UGGGGAUGGAUGCCCUGGUNN | 4147 | ACCAGGGCAUCCAUCCCCANN | 4148 |
| NM_005080_484-502 | GAGGAGGCGGAAGCCAAGGNN | 4149 | CCUUGGCUUCCGCCUCCUCNN | 4150 |
| NM_005080_489-507 | GGCGGAAGCCAAGGGGAAUNN | 4151 | AUUCCCCUUGGCUUCCGCCNN | 4152 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
| --- | --- | --- | --- | --- |
| NM_005080_574-592 | GUGCAGGCCCAGUUGUCACNN | 4153 | GUGACAACUGGGCCUGCACNN | 4154 |
| NM_005080_594-612 | CCUCCAGAACAUCUCCCCANN | 4155 | UGGGGAGAUGUUCUGGAGGNN | 4156 |
| NM_005080_604-622 | AUCUCCCCAUGGAUUCUGGNN | 4157 | CCAGAAUCCAUGGGGAGAUNN | 4158 |
| NM_005080_627-645 | AUUGACUCUUCAGAUUCAGNN | 4159 | CUGAAUCUGAAGAGUCAAUNN | 4160 |
| NM_005080_635-653 | UUCAGAUUCAGAGUCUGAUNN | 4161 | AUCAGACUCUGAAUCUGAANN | 4162 |
| NM_005080_636-654 | UCAGAUUCAGAGUCUGAUANN | 4163 | UAUCAGACUCUGAAUCUGANN | 4164 |
| NM_005080_666-684 | AUUCUGGACAACUUGGACCNN | 4165 | GGUCCAAGUUGUCCAGAAUNN | 4166 |
| NM_005080_667-685 | UUCUGGACAACUUGGACCCNN | 4167 | GGGUCCAAGUUGUCCAGAANN | 4168 |
| NM_005080_669-687 | CUGGACAACUUGGACCCAGNN | 4169 | CUGGGUCCAAGUUGUCCAGNN | 4170 |
| NM_005080_681-699 | GACCCAGUCAUGUUCUUCANN | 4171 | UGAAGAACAUGACUGGGUCNN | 4172 |
| NM_005080_690-708 | AUGUUCUUCAAAUGCCCUUNN | 4173 | AAGGGCAUUUGAAGAACAUNN | 4174 |
| NM_005080_718-736 | CUGCCAGCCUGGAGGAGCUNN | 4175 | AGCUCCUCCAGGCUGGCAGNN | 4176 |
| NM_005080_722-740 | CAGCCUGGAGGAGCUCCCANN | 4177 | UGGGAGCUCCUCCAGGCUGNN | 4178 |
| NM_005080_723-741 | AGCCUGGAGGAGCUCCCAGNN | 4179 | CUGGGAGCUCCUCCAGGCUNN | 4180 |
| NM_005080_724-742 | GCCUGGAGGAGCUCCCAGANN | 4181 | UCUGGGAGCUCCUCCAGGCNN | 4182 |
| NM_005080_725-743 | CCUGGAGGAGCUCCCAGAGNN | 4183 | CUCUGGGAGCUCCUCCAGGNN | 4184 |
| NM_005080_727-745 | UGGAGGAGCUCCCAGAGGUNN | 4185 | ACCUCUGGGAGCUCCUCCANN | 4186 |
| NM_005080_728-746 | GGAGGAGCUCCCAGAGGUCNN | 4187 | GACCUCUGGGAGCUCCUCCNN | 4188 |
| NM_005080_739-757 | CAGAGGUCUACCCAGAAGGNN | 4189 | CCUUCUGGGUAGACCUCUGNN | 4190 |
| NM_005080_747-765 | UACCCAGAAGGACCCAGUUNN | 4191 | AACUGGGUCCUUCUGGGUANN | 4192 |
| NM_005080_763-781 | GUUCCUUACCAGCCUCCCUNN | 4193 | AGGGAGGCUGGUAAGGAACNN | 4194 |
| NM_005080_764-782 | UUCCUUACCAGCCUCCCUUNN | 4195 | AAGGGAGGCUGGUAAGGAANN | 4196 |
| NM_005080_766-784 | CCUUACCAGCCUCCCUUUCNN | 4197 | GAAAGGGAGGCUGGUAAGGNN | 4198 |
| NM_005080_770-788 | ACCAGCCUCCCUUUCUCUGNN | 4199 | CAGAGAAAGGGAGGCUGGUNN | 4200 |
| NM_005080_774-792 | GCCUCCCUUUCUCUGUCAGNN | 4201 | CUGACAGAGAAAGGGAGGCNN | 4202 |
| NM_005080_780-798 | CUUUCUCUGUCAGUGGGANN | 4203 | UCCCCACUGACAGAGAAAGNN | 4204 |
| NM_005080_781-799 | UUUCUCUGUCAGUGGGACNN | 4205 | GUCCCACUGACAGAGAAANN | 4206 |
| NM_005080_805-823 | CAGCCAAGCUGGAAGCCAUNN | 4207 | AUGGCUUCCAGCUUGGCUGNN | 4208 |
| NM_005080_44-62 | GAGCUAUGGUGGUGGUGGCNN | 4209 | GCCACCACCACCAUAGCUCNN | 4210 |
| NM_005080_45-63 | AGCUAUGGUGGUGGUGGCANN | 4211 | UGCCACCACCACCAUAGCUNN | 4212 |
| NM_005080_868-886 | UCUUAGAGAUACCCUCUGANN | 4213 | UCAGAGGGUAUCUCUAAGANN | 4214 |
| NM_005080_875-893 | GAUACCCUCUGAGACAGAGNN | 4215 | CUCUGUCUCAGAGGGUAUCNN | 4216 |
| NM_005080_47-65 | CUAUGGUGGUGGUGGCAGCNN | 4217 | GCUGCCACCACCACCAUAGNN | 4218 |
| NM_005080_879-897 | CCCUCUGAGACAGAGAGCCNN | 4219 | GGCUCUCUGUCUCAGAGGGNN | 4220 |
| NM_005080_880-898 | CCUCUGAGACAGAGAGCCANN | 4221 | UGGCUCUCUGUCUCAGAGGNN | 4222 |
| NM_005080_881-899 | CUCUGAGACAGAGAGCCAANN | 4223 | UUGGCUCUCUGUCUCAGAGNN | 4224 |
| NM_005080_882-900 | UCUGAGACAGAGAGCCAAGNN | 4225 | CUUGGCUCUCUGUCUCAGANN | 4226 |

TABLE 9-continued

XBP-1 human/Rhesus siRNAs with 3' dinucleotide overhangs.

| Oligo Name/<br>location of<br>target sequence | sense (5'-3')<br>with 3' dinucleotide<br>overhang | SEQ<br>ID<br>NO: | antisense (5'-3')<br>with 3' dinucleotide<br>overhang | SEQ<br>ID<br>NO: |
|---|---|---|---|---|
| NM_005080_883-901 | CUGAGACAGAGAGCCAAGCNN | 4227 | GCUUGGCUCUCUGUCUCAGNN | 4228 |
| NM_005080_49-67 | AUGGUGGUGGUGGCAGCCGNN | 4229 | CGGCUGCCACCACCACCAUNN | 4230 |
| NM_005080_914-932 | GAAAAUCGAGGAAGCACCUNN | 4231 | AGGUGCUUCCUCGAUUUUCNN | 4232 |
| NM_005080_915-933 | AAAAUCGAGGAAGCACCUCNN | 4233 | GAGGUGCUUCCUCGAUUUUNN | 4234 |
| NM_005080_926-944 | AGCACCUCUCAGCCCCUCANN | 4235 | UGAGGGGCUGAGAGGUGCUNN | 4236 |
| NM_005080_945-963 | GAGAAUGAUCACCCUGAAUNN | 4237 | AUUCAGGGUGAUCAUUCUCNN | 4238 |
| NM_005080_958-976 | CUGAAUUCAUUGUCUCAGUNN | 4239 | ACUGAGACAAUGAAUUCAGNN | 4240 |
| NM_005080_959-977 | UGAAUUCAUUGUCUCAGUGNN | 4241 | CACUGAGACAAUGAAUUCANN | 4242 |
| NM_005080_962-980 | AUUCAUUGUCUCAGUGAAGNN | 4243 | CUUCACUGAGACAAUGAAUNN | 4244 |
| NM_005080_975-993 | GUGAAGGAAGAACCUGUAGNN | 4245 | CUACAGGUUCUUCCUUCACNN | 4246 |
| NM_005080_983-1001 | AGAACCUGUAGAAGAUGACNN | 4247 | GUCAUCUUCUACAGGUUCUNN | 4248 |
| NM_005080_128-146 | CCGCCGGAGCCCCGGCCGGNN | 4249 | CCGGCCGGGGCUCCGGCGGNN | 4250 |
| NM_005080_249-267 | GAGCCCCGAGGAGAAGGCGNN | 4251 | CGCCUUCUCCUCGGGGCUCNN | 4252 |
| NM_005080_697-715 | UCAAAUGCCCUUCCCCAGANN | 4253 | UCUGGGGAAGGGCAUUUGANN | 4254 |
| NM_005080_729-747 | GAGGAGCUCCCAGAGGUCUNN | 4255 | AGACCUCUGGGAGCUCCUCNN | 4256 |
| NM_005080_776-794 | CUCCCUUUCUCUGUCAGUGNN | 4257 | CACUGACAGAGAAAGGGAGNN | 4258 |
| NM_005080_803-821 | AUCAGCCAAGCUGGAAGCCNN | 4259 | GGCUUCCAGCUUGGCUGAUNN | 4260 |
| NM_005080_254-272 | CCGAGGAGAAGGCGCUGAGNN | 4261 | CUCAGCGCCUUCUCCUCGGNN | 4262 |
| NM_005080_383-401 | UUUUGCUAGAAAAUCAGCUNN | 4263 | AGCUGAUUUUCUAGCAAAANN | 4264 |
| NM_005080_116-134 | AGCCCGCCUCCGCCGCCGGNN | 4265 | CCGGCGGCGGAGGCGGGCUNN | 4266 |
| NM_005080_123-141 | CUCCGCCGCCGGAGCCCCGNN | 4267 | CGGGGCUCCGGCGGCGGAGNN | 4268 |
| NM_005080_125-143 | CCGCCGCCGGAGCCCCGGCNN | 4269 | GCCGGGGCUCCGGCGGCGGNN | 4270 |
| NM_005080_135-153 | AGCCCCGGCCGCCAGGCCNN | 4271 | GGCCUGGCCGGCCGGGGCUNN | 4272 |
| NM_005080_253-271 | CCCGAGGAGAAGGCGCUGANN | 4273 | UCAGCGCCUUCUCCUCGGGNN | 4274 |
| NM_005080_274-292 | AGGAAACUGAAAAACAGAGNN | 4275 | CUCUGUUUUUCAGUUUCCUNN | 4276 |
| NM_005080_655-673 | UCCUGUUGGGCAUUCUGGANN | 4277 | UCCAGAAUGCCCAACAGGANN | 4278 |
| NM_005080_775-793 | CCUCCCUUUCUCUGUCAGUNN | 4279 | ACUGACAGAGAAAGGGAGGNN | 4280 |
| NM_005080_46-64 | GCUAUGGUGGUGGUGGCAGNN | 4281 | CUGCCACCACCACCAUAGCNN | 4282 |
| NM_005080_1456-1474 | GUACUUUUAUCUUAAAAGGNN | 4283 | CCUUUUAAGAUAAAAGUACNN | 4284 |
| NM_005080_1545-1563 | UUAUGAAUGGUUCUUUAUCNN | 4285 | GAUAAAGAACCAUUCAUAANN | 4286 |
| NM_005080_1558-1576 | UUUAUCAUUUCUCUUCCCCNN | 4287 | GGGGAAGAGAAAUGAUAAANN | 4288 |
| NM_005080_121-139 | GCCUCCGCCGCCGGAGCCCNN | 4289 | GGGCUCCGGCGGCGGAGGCNN | 4290 |
| NM_005080_122-140 | CCUCCGCCGCCGGAGCCCCNN | 4291 | GGGGCUCCGGCGGCGGAGGNN | 4292 |
| NM_005080_247-265 | CUGAGCCCCGAGGAGAAGGNN | 4293 | CCUUCUCCUCGGGGCUCAGNN | 4294 |
| NM_005080_275-293 | GGAAACUGAAAAACAGAGUNN | 4295 | ACUCUGUUUUUCAGUUUCCNN | 4296 |
| NM_005080_276-294 | GAAACUGAAAAACAGAGUANN | 4297 | UACUCUGUUUUUCAGUUUCNN | 4298 |

TABLE 9-continued

XBP-1 human/Rhesus siRNAs with 3' dinucleotide overhangs.

| Oligo Name/ location of target sequence | sense (5'-3') with 3' dinucleotide overhang | SEQ ID NO: | antisense (5'-3') with 3' dinucleotide overhang | SEQ ID NO: |
|---|---|---|---|---|
| NM_005080_358-376 | GAUUUAGAAGAAGAGAACCNN | 4299 | GGUUCUCUUCUUCUAAAUCNN | 4300 |
| NM_005080_387-405 | GCUAGAAAAUCAGCUUUUANN | 4301 | UAAAAGCUGAUUUUCUAGCNN | 4302 |
| NM_005080_628-646 | UUGACUCUUCAGAUUCAGANN | 4303 | UCUGAAUCUGAAGAGUCAANN | 4304 |
| NM_005080_656-674 | CCUGUUGGGCAUUCUGGACNN | 4305 | GUCCAGAAUGCCCAACAGGNN | 4306 |
| NM_005080_719-737 | UGCCAGCCUGGAGGAGCUCNN | 4307 | GAGCUCCUCCAGGCUGGCANN | 4308 |
| NM_005080_720-738 | GCCAGCCUGGAGGAGCUCCNN | 4309 | GGAGCUCCUCCAGGCUGGCNN | 4310 |
| NM_005080_721-739 | CCAGCCUGGAGGAGCUCCCNN | 4311 | GGGAGCUCCUCCAGGCUGGNN | 4312 |
| NM_005080_782-800 | UUCUCUGUCAGUGGGGACGNN | 4313 | CGUCCCCACUGACAGAGAANN | 4314 |
| NM_005080_867-885 | GUCUUAGAGAUACCCUCUGNN | 4315 | CAGAGGGUAUCUCUAAGACNN | 4316 |
| NM_005080_48-66 | UAUGGUGGUGGUGGCAGCCNN | 4317 | GGCUGCCACCACCACCAUANN | 4318 |
| NM_005080_963-981 | UUCAUUGUCUCAGUGAAGGNN | 4319 | CCUUCACUGAGACAAUGAANN | 4320 |

Gene XBP1
reference transcript NM_005080 (human XBP 1 mRNA, FIG. 2)
Notes
19mers found in both human and rhesus

TABLE 10

XBP-1 Human/Rhesus siRNA analysis

| Oligo Name/ Location of Target sequence from 5' to 3' | human Antisense Count | human Antisense Score | human Sense Count | human Sense Score | rhesus Antisense Count | rhesus Antisense Score | rhesus Sense Count | rhesus Sense Score |
|---|---|---|---|---|---|---|---|---|
| NM_005080_390-408 | 1 | 4 | 6 | 3 | 2 | 3.4 | 2 | 2 |
| NM_005080_1184-1202 | 2 | 4 | 3 | 2 | 1 | 3.2 | 1 | 2 |
| NM_005080_1494-1512 | 1 | 4 | 3 | 3.2 | 12 | 3 | 2 | 3 |
| NM_005080_1463-1481 | 6 | 3.2 | 5 | 2 | 4 | 3.2 | 1 | 2 |
| NM_005080_610-628 | 3 | 3.2 | 6 | 3 | 6 | 3.2 | 2 | 2 |
| NM_005080_823-841 | 4 | 3.2 | 1 | 2 | 1 | 3.2 | 4 | 2 |
| NM_005080_1507-1525 | 3 | 3.2 | 2 | 2 | 3 | 3 | 2 | 2 |
| NM_005080_827-845 | 3 | 3.2 | 1 | 2.2 | 1 | 3 | 1 | 2 |
| NM_005080_1503-1521 | 5 | 3.2 | 2 | 2.8 | 1 | 2 | 1 | 1 |
| NM_005080_829-847 | 12 | 3.2 | 1 | 3 | 1 | 2 | 2 | 3 |
| NM_005080_1783-1801 | 12 | 3.2 | 3 | 2.2 | 2 | 1 | 1 | 2.2 |
| NM_005080_1183-1201 | 2 | 3 | 4 | 2 | 1 | 3.2 | 1 | 2 |
| NM_005080_1501-1519 | 4 | 3 | 2 | 2.8 | 2 | 3.2 | 1 | 2.2 |
| NM_005080_1504-1522 | 2 | 3 | 1 | 2 | 8 | 3.2 | 1 | 1 |
| NM_005080_734-752 | 6 | 3 | 1 | 2 | 1 | 3.2 | 3 | 2 |
| NM_005080_893-911 | 9 | 3 | 1 | 3 | 13 | 3.2 | 5 | 3 |
| NM_005080_1064-1082 | 6 | 3 | 5 | 3 | 1 | 3 | 3 | 2.2 |
| NM_005080_1066-1084 | 1 | 3 | 1 | 2 | 2 | 3 | 1 | 2.2 |
| NM_005080_1136-1154 | 7 | 3 | 1 | 0 | 5 | 3 | 1 | 2 |
| NM_005080_1137-1155 | 5 | 3 | 1 | 2 | 9 | 3 | 1 | 0 |
| NM_005080_1182-1200 | 1 | 3 | 1 | 2.8 | 1 | 3 | 2 | 2 |
| NM_005080_1186-1204 | 3 | 3 | 2 | 2 | 2 | 3 | 1 | 1.2 |
| NM_005080_1189-1207 | 1 | 3 | 3 | 2 | 5 | 3 | 3 | 2 |
| NM_005080_1224-1242 | 6 | 3 | 11 | 2 | 3 | 3 | 21 | 2 |
| NM_005080_1229-1247 | 4 | 3 | 6 | 2 | 1 | 3 | 3 | 2 |
| NM_005080_1235-1253 | 7 | 3 | 3 | 3 | 5 | 3 | 2 | 2.2 |
| NM_005080_1236-1254 | 8 | 3 | 2 | 3 | 7 | 3 | 1 | 3 |
| NM_005080_1438-1456 | 10 | 3 | 2 | 2.2 | 9 | 3 | 2 | 2.2 |
| NM_005080_1441-1459 | 3 | 3 | 3 | 2 | 11 | 3 | 4 | 2 |
| NM_005080_1442-1460 | 6 | 3 | 9 | 3.2 | 9 | 3 | 1 | 2 |
| NM_005080_1493-1511 | 1 | 3 | 2 | 3 | 1 | 3 | 1 | 2 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Anti-sense Count | Anti-sense Score | Sense Count | Sense Score | Antisense Count | Antisense Score | Sense Count | Sense Score |
| NM_005080_1502-1520 | 3 | 3 | 2 | 2 | 1 | 3 | 1 | 2 |
| NM_005080_1506-1524 | 4 | 3 | 6 | 2 | 6 | 3 | 6 | 2 |
| NM_005080_1594-1612 | 2 | 3 | 6 | 2 | 2 | 3 | 3 | 2 |
| NM_005080_1790-1808 | 12 | 3 | 1 | 2 | 9 | 3 | 4 | 3 |
| NM_005080_304-322 | 3 | 3 | 9 | 3 | 1 | 3 | 16 | 3 |
| NM_005080_305-323 | 1 | 3 | 1 | 2 | 3 | 3 | 3 | 2.2 |
| NM_005080_395-413 | 3 | 3 | 9 | 2 | 3 | 3 | 2 | 2 |
| NM_005080_609-627 | 3 | 3 | 3 | 3 | 7 | 3 | 1 | 2 |
| NM_005080_611-629 | 2 | 3 | 2 | 2 | 1 | 3 | 2 | 2 |
| NM_005080_617-635 | 3 | 3 | 1 | 3 | 4 | 3 | 1 | 2.2 |
| NM_005080_621-639 | 1 | 3 | 1 | 2.2 | 1 | 3 | 1 | 2.2 |
| NM_005080_641-659 | 1 | 3 | 3 | 2 | 2 | 3 | 4 | 2 |
| NM_005080_648-666 | 5 | 3 | 2 | 2 | 4 | 3 | 1 | 2 |
| NM_005080_651-669 | 4 | 3 | 1 | 2 | 5 | 3 | 10 | 3 |
| NM_005080_735-753 | 1 | 3 | 1 | 2 | 4 | 3 | 2 | 2 |
| NM_005080_753-771 | 3 | 3 | 2 | 2 | 10 | 3 | 4 | 2 |
| NM_005080_794-812 | 3 | 3 | 2 | 2 | 6 | 3 | 1 | 2 |
| NM_005080_826-844 | 1 | 3 | 1 | 2.2 | 4 | 3 | 13 | 3 |
| NM_005080_836-854 | 2 | 3 | 1 | 3 | 8 | 3 | 2 | 3 |
| NM_005080_840-858 | 2 | 3 | 1 | 2.2 | 3 | 3 | 7 | 3 |
| NM_005080_841-859 | 8 | 3 | 1 | 1 | 6 | 3 | 1 | 2 |
| NM_005080_847-865 | 10 | 3 | 1 | 2 | 5 | 3 | 1 | 2 |
| NM_005080_894-912 | 2 | 3 | 4 | 3 | 1 | 3 | 1 | 3 |
| NM_005080_895-913 | 2 | 3 | 1 | 3 | 8 | 3 | 2 | 2.2 |
| NM_005080_896-914 | 3 | 3 | 2 | 2 | 7 | 3 | 2 | 2 |
| NM_005080_899-917 | 3 | 3 | 1 | 2 | 7 | 3 | 6 | 2 |
| NM_005080_908-926 | 2 | 3 | 2 | 2 | 1 | 3 | 2 | 3.2 |
| NM_005080_917-935 | 4 | 3 | 6 | 3.2 | 8 | 3 | 1 | 3.2 |
| NM_005080_937-955 | 2 | 3 | 2 | 2 | 9 | 3 | 1 | 2 |
| NM_005080_950-968 | 7 | 3 | 1 | 2 | 12 | 3 | 1 | 2.8 |
| NM_005080_1185-1203 | 1 | 3 | 1 | 2 | 1 | 2.8 | 1 | 2 |
| NM_005080_1187-1205 | 2 | 3 | 1 | 2.2 | 2 | 2.8 | 2 | 2.2 |
| NM_005080_1153-1171 | 6 | 3 | 2 | 2 | 1 | 2.4 | 3 | 2 |
| NM_005080_1787-1805 | 1 | 3 | 1 | 2 | 1 | 2.4 | 1 | 2 |
| NM_005080_606-624 | 4 | 3 | 2 | 2.2 | 1 | 2.4 | 1 | 1 |
| NM_005080_1019-1037 | 12 | 3 | 1 | 1 | 1 | 2.2 | 2 | 1 |
| NM_005080_1072-1090 | 14 | 3 | 8 | 2 | 2 | 2.2 | 9 | 2 |
| NM_005080_1228-1246 | 1 | 3 | 6 | 2 | 1 | 2.2 | 4 | 2 |
| NM_005080_1461-1479 | 12 | 3 | 2 | 1 | 1 | 2.2 | 1 | 2.2 |
| NM_005080_1495-1513 | 2 | 3 | 4 | 3 | 1 | 2.2 | 1 | 3 |
| NM_005080_1496-1514 | 2 | 3 | 2 | 2.8 | 1 | 2.2 | 1 | 2.8 |
| NM_005080_1500-1518 | 1 | 3 | 1 | 1.2 | 1 | 2.2 | 1 | 2.2 |
| NM_005080_1644-1662 | 9 | 3 | 7 | 2 | 1 | 2.2 | 3 | 2 |
| NM_005080_1708-1726 | 3 | 3 | 1 | 1 | 1 | 2.2 | 1 | 2 |
| NM_005080_302-320 | 1 | 3 | 5 | 3 | 1 | 2.2 | 1 | 2 |
| NM_005080_607-625 | 2 | 3 | 1 | 2 | 1 | 2.2 | 3 | 2.2 |
| NM_005080_824-842 | 4 | 3 | 1 | 2 | 1 | 2.2 | 4 | 2 |
| NM_005080_953-971 | 8 | 3 | 4 | 2 | 2 | 2.2 | 5 | 2 |
| NM_005080_1011-1029 | 2 | 3 | 4 | 2 | 1 | 2 | 1 | 2.4 |
| NM_005080_1230-1248 | 2 | 3 | 1 | 2 | 3 | 2 | 2 | 2.2 |
| NM_005080_1231-1249 | 4 | 3 | 1 | 2 | 1 | 2 | 4 | 3 |
| NM_005080_1290-1308 | 7 | 3 | 1 | 2 | 1 | 2 | 1 | 2 |
| NM_005080_1331-1349 | 4 | 3 | 5 | 2 | 2 | 2 | 11 | 2 |
| NM_005080_1460-1478 | 16 | 3 | 15 | 3 | 2 | 2 | 1 | 2.8 |
| NM_005080_1670-1688 | 1 | 3 | 24 | 3 | 2 | 2 | 1 | 2 |
| NM_005080_1671-1689 | 2 | 3 | 1 | 2.2 | 1 | 2 | 2 | 2.2 |
| NM_005080_1735-1753 | 21 | 3 | 3 | 2 | 2 | 2 | 4 | 2 |
| NM_005080_1744-1762 | 1 | 3 | 1 | 2 | 1 | 2 | 2 | 2 |
| NM_005080_1796-1814 | 12 | 3 | 2 | 0 | 1 | 2 | 1 | 0 |
| NM_005080_343-361 | 7 | 3 | 7 | 2 | 1 | 2 | 1 | 2 |
| NM_005080_374-392 | 1 | 3 | 3 | 2 | 1 | 2 | 2 | 2 |
| NM_005080_375-393 | 6 | 3 | 1 | 1 | 3 | 2 | 7 | 1 |
| NM_005080_608-626 | 1 | 3 | 1 | 2 | 2 | 2 | 1 | 2.4 |
| NM_005080_652-670 | 7 | 3 | 1 | 2 | 1 | 2 | 1 | 2 |
| NM_005080_686-704 | 9 | 3 | 1 | 2 | 9 | 2 | 1 | 2 |
| NM_005080_909-927 | 3 | 3 | 2 | 2 | 2 | 2 | 1 | 2 |
| NM_005080_951-969 | 3 | 3 | 1 | 2.8 | 6 | 2 | 4 | 2 |
| NM_005080_952-970 | 8 | 3 | 3 | 2 | 1 | 2 | 5 | 2 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Antisense Count | Antisense Score | Sense Count | Sense Score | Antisense Count | Antisense Score | Sense Count | Sense Score |
| NM_005080_825-843 | 3 | 3 | 2 | 2.2 | 1 | 1.2 | 6 | 2.2 |
| NM_005080_1194-1212 | 4 | 3 | 1 | 2.2 | 2 | 1 | 2 | 3 |
| NM_005080_831-849 | 3 | 3 | 1 | 2 | 1 | 1 | 3 | 3.2 |
| NM_005080_835-853 | 1 | 3 | 1 | 3 | 1 | 1 | 2 | 3 |
| NM_005080_869-887 | 2 | 3 | 1 | 2.2 | 1 | 1 | 3 | 3.2 |
| NM_005080_1246-1264 | 3 | 2.8 | 1 | 2.2 | 1 | 2.8 | 2 | 2.2 |
| NM_005080_1453-1471 | 2 | 2.8 | 8 | 2 | 3 | 2.8 | 4 | 2 |
| NM_005080_1512-1530 | 5 | 2.8 | 10 | 2.2 | 2 | 2.8 | 11 | 3 |
| NM_005080_1546-1564 | 1 | 2.8 | 1 | 2 | 1 | 2.8 | 3 | 2 |
| NM_005080_1789-1807 | 1 | 2.8 | 1 | 3 | 1 | 2.8 | 1 | 3 |
| NM_005080_325-343 | 1 | 2.8 | 3 | 3 | 1 | 2.8 | 1 | 3 |
| NM_005080_393-411 | 2 | 2.8 | 4 | 3 | 1 | 2.8 | 8 | 3 |
| NM_005080_788-806 | 1 | 2.8 | 2 | 2 | 1 | 2.8 | 4 | 2 |
| NM_005080_821-839 | 1 | 2.8 | 11 | 3 | 1 | 2.8 | 1 | 2 |
| NM_005080_1514-1532 | 6 | 2.8 | 1 | 1 | 1 | 2.2 | 9 | 3 |
| NM_005080_1797-1815 | 1 | 2.8 | 2 | 1 | 11 | 2.2 | 1 | 1 |
| NM_005080_833-851 | 1 | 2.8 | 3 | 4 | 2 | 2.2 | 4 | 4 |
| NM_005080_1509-1527 | 1 | 2.8 | 1 | 2 | 2 | 2 | 1 | 2 |
| NM_005080_1802-1820 | 1 | 2.8 | 1 | 1.2 | 1 | 1.2 | 1 | 1.2 |
| NM_005080_391-409 | 1 | 2.4 | 1 | 2 | 1 | 3 | 1 | 2 |
| NM_005080_843-861 | 1 | 2.4 | 1 | 1 | 4 | 2.4 | 6 | 3 |
| NM_005080_1508-1526 | 1 | 2.4 | 7 | 3 | 1 | 2 | 1 | 2 |
| NM_005080_1754-1772 | 1 | 2.4 | 4 | 2 | 1 | 2 | 1 | 2 |
| NM_005080_430-448 | 4 | 2.4 | 1 | 2 | 1 | 2 | 3 | 2 |
| NM_005080_437-455 | 1 | 2.4 | 5 | 2.2 | 1 | 2 | 4 | 2.2 |
| NM_005080_1465-1483 | 1 | 2.2 | 2 | 2.2 | 2 | 3.2 | 7 | 3 |
| NM_005080_1742-1760 | 1 | 2.2 | 2 | 2 | 13 | 3.2 | 5 | 3 |
| NM_005080_438-456 | 1 | 2.2 | 1 | 1 | 12 | 3.2 | 1 | 2.2 |
| NM_005080_1060-1078 | 1 | 2.2 | 2 | 2 | 12 | 3 | 5 | 2 |
| NM_005080_1067-1085 | 1 | 2.2 | 2 | 2 | 6 | 3 | 1 | 3 |
| NM_005080_1197-1215 | 2 | 2.2 | 1 | 3 | 2 | 3 | 1 | 3 |
| NM_005080_1198-1216 | 1 | 2.2 | 3 | 3 | 9 | 3 | 2 | 3 |
| NM_005080_1424-1442 | 1 | 2.2 | 1 | 2.4 | 7 | 3 | 1 | 2.4 |
| NM_005080_1464-1482 | 2 | 2.2 | 4 | 2 | 1 | 3 | 6 | 2 |
| NM_005080_616-634 | 1 | 2.2 | 1 | 3 | 4 | 3 | 2 | 3 |
| NM_005080_757-775 | 1 | 2.2 | 1 | 2 | 12 | 3 | 1 | 2.2 |
| NM_005080_785-803 | 2 | 2.2 | 1 | 1.2 | 3 | 3 | 1 | 1 |
| NM_005080_819-837 | 1 | 2.2 | 2 | 1 | 4 | 3 | 12 | 2 |
| NM_005080_842-860 | 1 | 2.2 | 1 | 1 | 2 | 3 | 6 | 3 |
| NM_005080_845-863 | 1 | 2.2 | 4 | 3 | 1 | 3 | 11 | 3 |
| NM_005080_1013-1031 | 1 | 2.2 | 1 | 1 | 1 | 2.8 | 2 | 1 |
| NM_005080_1431-1449 | 6 | 2.2 | 1 | 1.2 | 1 | 2.8 | 1 | 1.2 |
| NM_005080_1673-1691 | 3 | 2.2 | 3 | 2.2 | 1 | 2.8 | 5 | 2.2 |
| NM_005080_283-301 | 2 | 2.2 | 2 | 2 | 5 | 2.8 | 1 | 2.2 |
| NM_005080_838-856 | 1 | 2.2 | 1 | 2 | 1 | 2.8 | 1 | 2 |
| NM_005080_279-297 | 2 | 2.2 | 7 | 2 | 1 | 2.4 | 2 | 1 |
| NM_005080_633-651 | 1 | 2.2 | 2 | 0 | 1 | 2.4 | 9 | 2 |
| NM_005080_1024-1042 | 2 | 2.2 | 9 | 2 | 1 | 2.2 | 4 | 2 |
| NM_005080_1147-1165 | 2 | 2.2 | 4 | 1 | 1 | 2.2 | 1 | 1 |
| NM_005080_1154-1172 | 1 | 2.2 | 4 | 2 | 4 | 2.2 | 5 | 2 |
| NM_005080_1188-1206 | 2 | 2.2 | 1 | 1 | 4 | 2.2 | 3 | 1 |
| NM_005080_1192-1210 | 2 | 2.2 | 4 | 2 | 1 | 2.2 | 2 | 2 |
| NM_005080_1195-1213 | 2 | 2.2 | 1 | 2.2 | 3 | 2.2 | 2 | 3 |
| NM_005080_1238-1256 | 2 | 2.2 | 2 | 3 | 2 | 2.2 | 1 | 3 |
| NM_005080_1548-1566 | 1 | 2.2 | 1 | 2.2 | 1 | 2.2 | 2 | 2.2 |
| NM_005080_1549-1567 | 3 | 2.2 | 1 | 2 | 9 | 2.2 | 3 | 2 |
| NM_005080_1677-1695 | 1 | 2.2 | 1 | 2.8 | 2 | 2.2 | 2 | 2 |
| NM_005080_1707-1725 | 1 | 2.2 | 4 | 2 | 1 | 2.2 | 2 | 2 |
| NM_005080_1713-1731 | 1 | 2.2 | 1 | 1 | 3 | 2.2 | 2 | 2 |
| NM_005080_1786-1804 | 6 | 2.2 | 1 | 2 | 6 | 2.2 | 3 | 2 |
| NM_005080_210-228 | 1 | 2.2 | 10 | 2 | 5 | 2.2 | 12 | 2 |
| NM_005080_278-296 | 1 | 2.2 | 6 | 1 | 2 | 2.2 | 14 | 1 |
| NM_005080_284-302 | 4 | 2.2 | 1 | 2 | 8 | 2.2 | 9 | 2 |
| NM_005080_290-308 | 2 | 2.2 | 1 | 2 | 3 | 2.2 | 1 | 2 |
| NM_005080_342-360 | 3 | 2.2 | 1 | 2 | 4 | 2.2 | 5 | 3 |
| NM_005080_431-449 | 8 | 2.2 | 1 | 1 | 4 | 2.2 | 1 | 1 |
| NM_005080_576-594 | 1 | 2.2 | 3 | 2 | 7 | 2.2 | 1 | 2 |
| NM_005080_602-620 | 3 | 2.2 | 2 | 2 | 2 | 2.2 | 4 | 2 |

TABLE 10-continued

XBP-1 Human/Rhesus siRNA analysis

| Oligo Name/ Location of Target sequence from 5' to 3' | off target | | | | | | | |
|---|---|---|---|---|---|---|---|---|
| | human | | | | rhesus | | | |
| | Antisense Count | Antisense Score | Sense Count | Sense Score | Antisense Count | Antisense Score | Sense Count | Sense Score |
| NM_005080_618-636 | 2 | 2.2 | 1 | 3 | 1 | 2.2 | 1 | 3 |
| NM_005080_678-696 | 1 | 2.2 | 1 | 1 | 6 | 2.2 | 1 | 2 |
| NM_005080_796-814 | 4 | 2.2 | 1 | 3 | 1 | 2.2 | 2 | 2.2 |
| NM_005080_940-958 | 1 | 2.2 | 9 | 3 | 3 | 2.2 | 1 | 2 |
| NM_005080_954-972 | 5 | 2.2 | 9 | 2 | 3 | 2.2 | 1 | 1 |
| NM_005080_977-995 | 2 | 2.2 | 1 | 2 | 1 | 2.2 | 1 | 1.2 |
| NM_005080_1018-1036 | 1 | 2.2 | 1 | 1 | 2 | 2 | 1 | 1 |
| NM_005080_1026-1044 | 2 | 2.2 | 8 | 2 | 1 | 2 | 2 | 2 |
| NM_005080_1138-1156 | 1 | 2.2 | 1 | 2 | 1 | 2 | 1 | 0 |
| NM_005080_1141-1159 | 1 | 2.2 | 3 | 2 | 1 | 2 | 8 | 2 |
| NM_005080_1142-1160 | 2 | 2.2 | 2 | 2.2 | 2 | 2 | 1 | 2.8 |
| NM_005080_1155-1173 | 1 | 2.2 | 3 | 2 | 2 | 2 | 3 | 2 |
| NM_005080_1158-1176 | 1 | 2.2 | 1 | 2.2 | 1 | 2 | 1 | 2 |
| NM_005080_1193-1211 | 2 | 2.2 | 1 | 2 | 2 | 2 | 1 | 2 |
| NM_005080_1196-1214 | 2 | 2.2 | 2 | 3 | 5 | 2 | 2 | 2.8 |
| NM_005080_1219-1237 | 2 | 2.2 | 3 | 2 | 3 | 2 | 7 | 2.2 |
| NM_005080_107-125 | 3 | 2.2 | 1 | 0 | 1 | 2 | 2 | 0 |
| NM_005080_108-126 | 4 | 2.2 | 1 | 0 | 1 | 2 | 2 | 0 |
| NM_005080_1505-1523 | 1 | 2.2 | 1 | 2 | 5 | 2 | 1 | 2 |
| NM_005080_1567-1585 | 4 | 2.2 | 1 | 1.2 | 1 | 2 | 1 | 2 |
| NM_005080_1672-1690 | 2 | 2.2 | 2 | 2.2 | 1 | 2 | 6 | 3 |
| NM_005080_1678-1696 | 4 | 2.2 | 1 | 2.8 | 1 | 2 | 2 | 2.8 |
| NM_005080_1778-1796 | 4 | 2.2 | 7 | 2 | 2 | 2 | 9 | 2 |
| NM_005080_1779-1797 | 1 | 2.2 | 9 | 2 | 4 | 2 | 1 | 1 |
| NM_005080_280-298 | 5 | 2.2 | 7 | 2 | 1 | 2 | 2 | 1 |
| NM_005080_282-300 | 2 | 2.2 | 2 | 2 | 1 | 2 | 2 | 2 |
| NM_005080_288-306 | 1 | 2.2 | 1 | 1 | 2 | 2 | 1 | 1 |
| NM_005080_291-309 | 3 | 2.2 | 2 | 2 | 5 | 2 | 1 | 2 |
| NM_005080_347-365 | 3 | 2.2 | 2 | 2.4 | 1 | 2 | 4 | 3 |
| NM_005080_397-415 | 4 | 2.2 | 20 | 3 | 1 | 2 | 1 | 2.2 |
| NM_005080_398-416 | 1 | 2.2 | 1 | 2.2 | 2 | 2 | 1 | 2.2 |
| NM_005080_399-417 | 2 | 2.2 | 1 | 2 | 2 | 2 | 3 | 2.2 |
| NM_005080_512-530 | 2 | 2.2 | 1 | 2 | 1 | 2 | 9 | 2 |
| NM_005080_517-535 | 2 | 2.2 | 1 | 0 | 1 | 2 | 1 | 0 |
| NM_005080_596-614 | 1 | 2.2 | 5 | 2 | 3 | 2 | 4 | 2 |
| NM_005080_598-616 | 1 | 2.2 | 4 | 2 | 3 | 2 | 7 | 2 |
| NM_005080_601-619 | 2 | 2.2 | 8 | 3 | 1 | 2 | 1 | 2.2 |
| NM_005080_605-623 | 2 | 2.2 | 5 | 2 | 5 | 2 | 9 | 2 |
| NM_005080_661-679 | 2 | 2.2 | 8 | 2 | 1 | 2 | 1 | 1 |
| NM_005080_688-706 | 1 | 2.2 | 2 | 0 | 2 | 2 | 2 | 1 |
| NM_005080_691-709 | 2 | 2.2 | 8 | 2 | 2 | 2 | 15 | 2 |
| NM_005080_828-846 | 1 | 2.2 | 3 | 3.2 | 1 | 2 | 1 | 2 |
| NM_005080_830-848 | 8 | 2.2 | 1 | 2.8 | 2 | 2 | 2 | 3 |
| NM_005080_834-852 | 2 | 2.2 | 6 | 3 | 3 | 2 | 3 | 3 |
| NM_005080_846-864 | 2 | 2.2 | 1 | 2 | 1 | 2 | 1 | 2 |
| NM_005080_870-888 | 4 | 2.2 | 1 | 2.2 | 1 | 2 | 7 | 3.2 |
| NM_005080_891-909 | 2 | 2.2 | 6 | 2 | 2 | 2 | 5 | 2 |
| NM_005080_900-918 | 2 | 2.2 | 1 | 2 | 2 | 2 | 1 | 2.2 |
| NM_005080_911-929 | 3 | 2.2 | 2 | 3 | 1 | 2 | 1 | 2.2 |
| NM_005080_912-930 | 3 | 2.2 | 7 | 3.2 | 1 | 2 | 1 | 2.2 |
| NM_005080_979-997 | 5 | 2.2 | 2 | 2 | 1 | 2 | 5 | 2.2 |
| NM_005080_1366-1384 | 5 | 2.2 | 2 | 1.2 | 1 | 1.2 | 1 | 1.2 |
| NM_005080_150-168 | 4 | 2.2 | 8 | 1 | 1 | 1.2 | 1 | 2 |
| NM_005080_1437-1455 | 1 | 2.2 | 2 | 2.2 | 1 | 1 | 1 | 2 |
| NM_005080_482-500 | 5 | 2.2 | 4 | 2 | 6 | 1 | 4 | 2 |
| NM_005080_580-598 | 1 | 2.2 | 1 | 2 | 1 | 1 | 3 | 2 |
| NM_005080_613-631 | 1 | 2 | 6 | 3 | 2 | 4.2 | 2 | 3 |
| NM_005080_1065-1083 | 4 | 2 | 1 | 3.4 | 3 | 4 | 3 | 2.2 |
| NM_005080_614-632 | 1 | 2 | 1 | 2 | 8 | 3.2 | 1 | 2 |
| NM_005080_640-658 | 1 | 2 | 3 | 2 | 3 | 3.2 | 1 | 2 |
| NM_005080_1014-1032 | 2 | 2 | 1 | 2 | 16 | 3 | 2 | 2 |
| NM_005080_1015-1033 | 3 | 2 | 2 | 1.2 | 1 | 3 | 1 | 2.2 |
| NM_005080_1146-1164 | 1 | 2 | 3 | 2 | 28 | 3 | 2 | 2 |
| NM_005080_1232-1250 | 1 | 2 | 1 | 2 | 5 | 3 | 1 | 3 |
| NM_005080_1234-1252 | 1 | 2 | 1 | 2 | 1 | 3 | 1 | 2.2 |
| NM_005080_1237-1255 | 1 | 2 | 4 | 3 | 10 | 3 | 5 | 3 |
| NM_005080_1443-1461 | 1 | 2 | 2 | 2 | 9 | 3 | 6 | 2.2 |
| NM_005080_1462-1480 | 2 | 2 | 2 | 2 | 4 | 3 | 3 | 3 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Anti-sense Count | Anti-sense Score | Sense Count | Sense Score | Antisense Count | Antisense Score | Sense Count | Sense Score |
| NM_005080_1510-1528 | 1 | 2 | 1 | 2 | 4 | 3 | 1 | 2 |
| NM_005080_1591-1609 | 3 | 2 | 1 | 1 | 4 | 3 | 2 | 1.2 |
| NM_005080_1615-1633 | 1 | 2 | 1 | 2 | 2 | 3 | 8 | 2 |
| NM_005080_1716-1734 | 4 | 2 | 6 | 3 | 9 | 3 | 1 | 1 |
| NM_005080_1718-1736 | 1 | 2 | 7 | 3 | 20 | 3 | 1 | 2.2 |
| NM_005080_1725-1743 | 1 | 2 | 1 | 2.2 | 16 | 3 | 2 | 2 |
| NM_005080_1748-1766 | 1 | 2 | 1 | 4 | 7 | 3 | 2 | 3.2 |
| NM_005080_1780-1798 | 2 | 2 | 4 | 2 | 5 | 3 | 9 | 2 |
| NM_005080_1794-1812 | 2 | 2 | 1 | 2 | 6 | 3 | 2 | 2 |
| NM_005080_156-174 | 2 | 2 | 4 | 2 | 21 | 3 | 2 | 1 |
| NM_005080_299-317 | 1 | 2 | 2 | 2 | 10 | 3 | 2 | 2 |
| NM_005080_344-362 | 1 | 2 | 5 | 2.2 | 7 | 3 | 1 | 2.2 |
| NM_005080_371-389 | 3 | 2 | 6 | 3 | 20 | 3 | 1 | 2.2 |
| NM_005080_373-391 | 1 | 2 | 3 | 2 | 5 | 3 | 1 | 2 |
| NM_005080_524-542 | 4 | 2 | 2 | 2 | 3 | 3 | 4 | 3 |
| NM_005080_525-543 | 3 | 2 | 6 | 2 | 6 | 3 | 3 | 2 |
| NM_005080_612-630 | 1 | 2 | 3 | 2 | 1 | 3 | 8 | 3 |
| NM_005080_615-633 | 1 | 2 | 1 | 2 | 1 | 3 | 1 | 2 |
| NM_005080_645-663 | 1 | 2 | 1 | 1 | 6 | 3 | 3 | 1 |
| NM_005080_792-810 | 1 | 2 | 2 | 2.2 | 10 | 3 | 2 | 2 |
| NM_005080_905-923 | 2 | 2 | 1 | 2.2 | 1 | 3 | 4 | 3 |
| NM_005080_976-994 | 1 | 2 | 4 | 2 | 4 | 3 | 4 | 2 |
| NM_005080_1244-1262 | 3 | 2 | 7 | 2 | 1 | 2.8 | 5 | 2 |
| NM_005080_1791-1809 | 5 | 2 | 4 | 2 | 1 | 2.8 | 2 | 2.8 |
| NM_005080_755-773 | 5 | 2 | 4 | 2 | 1 | 2.8 | 4 | 2 |
| NM_005080_799-817 | 3 | 2 | 2 | 2 | 1 | 2.8 | 16 | 2 |
| NM_005080_832-850 | 3 | 2 | 3 | 3 | 1 | 2.8 | 4 | 3 |
| NM_005080_839-857 | 1 | 2 | 2 | 2.2 | 1 | 2.8 | 3 | 2 |
| NM_005080_100-118 | 3 | 2 | 6 | 2 | 1 | 2.4 | 2 | 1 |
| NM_005080_281-299 | 7 | 2 | 3 | 2 | 1 | 2.4 | 10 | 2 |
| NM_005080_822-840 | 1 | 2 | 5 | 2.2 | 1 | 2.4 | 1 | 2.2 |
| NM_005080_1152-1170 | 1 | 2 | 3 | 2 | 3 | 2.2 | 2 | 2.2 |
| NM_005080_1191-1209 | 3 | 2 | 4 | 1 | 1 | 2.2 | 3 | 2 |
| NM_005080_1225-1243 | 2 | 2 | 5 | 2 | 2 | 2.2 | 1 | 1 |
| NM_005080_1227-1245 | 3 | 2 | 1 | 1 | 1 | 2.2 | 1 | 1 |
| NM_005080_1239-1257 | 2 | 2 | 1 | 2 | 5 | 2.2 | 1 | 2 |
| NM_005080_1430-1448 | 2 | 2 | 2 | 2 | 4 | 2.2 | 2 | 2.2 |
| NM_005080_1499-1517 | 1 | 2 | 4 | 2.2 | 4 | 2.2 | 10 | 2.2 |
| NM_005080_1553-1571 | 1 | 2 | 2 | 2.2 | 2 | 2.2 | 8 | 2 |
| NM_005080_1585-1603 | 1 | 2 | 1 | 2 | 5 | 2.2 | 1 | 1 |
| NM_005080_1592-1610 | 3 | 2 | 2 | 2 | 2 | 2.2 | 3 | 2 |
| NM_005080_1743-1761 | 1 | 2 | 2 | 2 | 1 | 2.2 | 4 | 2 |
| NM_005080_154-172 | 1 | 2 | 1 | 2.2 | 2 | 2.2 | 5 | 3 |
| NM_005080_193-211 | 1 | 2 | 1 | 1 | 10 | 2.2 | 1 | 1 |
| NM_005080_199-217 | 10 | 2 | 3 | 2 | 5 | 2.2 | 4 | 3 |
| NM_005080_292-310 | 5 | 2 | 3 | 2 | 1 | 2.2 | 2 | 2 |
| NM_005080_341-359 | 1 | 2 | 1 | 2 | 2 | 2.2 | 1 | 2.2 |
| NM_005080_377-395 | 4 | 2 | 1 | 1 | 5 | 2.2 | 7 | 2 |
| NM_005080_519-537 | 1 | 2 | 3 | 1 | 12 | 2.2 | 4 | 2 |
| NM_005080_522-540 | 2 | 2 | 8 | 2 | 1 | 2.2 | 5 | 2 |
| NM_005080_577-595 | 2 | 2 | 6 | 2 | 8 | 2.2 | 3 | 2 |
| NM_005080_599-617 | 4 | 2 | 5 | 2 | 7 | 2.2 | 5 | 2 |
| NM_005080_754-772 | 2 | 2 | 5 | 3 | 1 | 2.2 | 1 | 2 |
| NM_005080_888-906 | 1 | 2 | 1 | 2.2 | 4 | 2.2 | 1 | 2 |
| NM_005080_939-957 | 1 | 2 | 1 | 2.8 | 2 | 2.2 | 1 | 2 |
| NM_005080_964-982 | 1 | 2 | 1 | 1 | 1 | 2.2 | 4 | 2 |
| NM_005080_1012-1030 | 6 | 2 | 4 | 3 | 4 | 2 | 3 | 3.2 |
| NM_005080_1016-1034 | 4 | 2 | 2 | 1.2 | 1 | 2 | 10 | 3 |
| NM_005080_1020-1038 | 7 | 2 | 2 | 2 | 2 | 2 | 4 | 2 |
| NM_005080_1025-1043 | 2 | 2 | 9 | 2 | 3 | 2 | 2 | 2.2 |
| NM_005080_1027-1045 | 1 | 2 | 1 | 2 | 1 | 2 | 1 | 2 |
| NM_005080_1028-1046 | 1 | 2 | 5 | 2 | 3 | 2 | 8 | 2 |
| NM_005080_1030-1048 | 1 | 2 | 2 | 2 | 1 | 2 | 1 | 2 |
| NM_005080_1031-1049 | 16 | 2 | 2 | 2 | 4 | 2 | 1 | 2 |
| NM_005080_1032-1050 | 3 | 2 | 21 | 3 | 2 | 2 | 4 | 2.8 |
| NM_005080_1033-1051 | 11 | 2 | 1 | 2 | 7 | 2 | 2 | 2.2 |
| NM_005080_1056-1074 | 1 | 2 | 6 | 2 | 2 | 2 | 13 | 2 |
| NM_005080_1057-1075 | 3 | 2 | 2 | 2.2 | 2 | 2 | 1 | 2 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Antisense Count | Antisense Score | Sense Count | Sense Score | Antisense Count | Antisense Score | Sense Count | Sense Score |
| NM_005080_1058-1076 | 4 | 2 | 2 | 1 | 5 | 2 | 2 | 1 |
| NM_005080_1059-1077 | 5 | 2 | 2 | 2 | 13 | 2 | 3 | 2 |
| NM_005080_1061-1079 | 4 | 2 | 3 | 2 | 16 | 2 | 1 | 1.2 |
| NM_005080_1063-1081 | 11 | 2 | 3 | 2 | 1 | 2 | 4 | 2 |
| NM_005080_1069-1087 | 2 | 2 | 10 | 3 | 1 | 2 | 1 | 2 |
| NM_005080_1071-1089 | 2 | 2 | 2 | 3 | 1 | 2 | 2 | 3 |
| NM_005080_1073-1091 | 4 | 2 | 12 | 3 | 4 | 2 | 3 | 2 |
| NM_005080_1075-1093 | 6 | 2 | 2 | 2.2 | 6 | 2 | 3 | 2.2 |
| NM_005080_1076-1094 | 7 | 2 | 4 | 3 | 7 | 2 | 1 | 3 |
| NM_005080_1078-1096 | 4 | 2 | 3 | 2 | 3 | 2 | 12 | 2 |
| NM_005080_1139-1157 | 1 | 2 | 2 | 2 | 2 | 2 | 1 | 0 |
| NM_005080_1140-1158 | 4 | 2 | 3 | 2 | 2 | 2 | 1 | 2 |
| NM_005080_1143-1161 | 2 | 2 | 2 | 2.2 | 3 | 2 | 1 | 3 |
| NM_005080_1144-1162 | 1 | 2 | 2 | 2 | 1 | 2 | 3 | 2 |
| NM_005080_1145-1163 | 1 | 2 | 1 | 2.2 | 1 | 2 | 2 | 2 |
| NM_005080_1148-1166 | 2 | 2 | 4 | 2 | 1 | 2 | 2 | 2 |
| NM_005080_1156-1174 | 12 | 2 | 1 | 2.2 | 6 | 2 | 1 | 2 |
| NM_005080_1157-1175 | 1 | 2 | 2 | 2 | 1 | 2 | 1 | 1 |
| NM_005080_1159-1177 | 1 | 2 | 1 | 2 | 4 | 2 | 3 | 2 |
| NM_005080_1160-1178 | 1 | 2 | 1 | 1.2 | 3 | 2 | 2 | 2 |
| NM_005080_1190-1208 | 1 | 2 | 2 | 2.2 | 5 | 2 | 2 | 2 |
| NM_005080_1218-1236 | 2 | 2 | 1 | 2 | 16 | 2 | 4 | 2.2 |
| NM_005080_1220-1238 | 5 | 2 | 1 | 1 | 4 | 2 | 1 | 1 |
| NM_005080_1221-1239 | 5 | 2 | 1 | 1 | 10 | 2 | 1 | 1 |
| NM_005080_1233-1251 | 1 | 2 | 3 | 3 | 1 | 2 | 1 | 3 |
| NM_005080_1240-1258 | 6 | 2 | 1 | 2 | 4 | 2 | 1 | 2 |
| NM_005080_1241-1259 | 13 | 2 | 2 | 2 | 13 | 2 | 1 | 2 |
| NM_005080_1242-1260 | 3 | 2 | 3 | 2 | 4 | 2 | 3 | 2 |
| NM_005080_1243-1261 | 1 | 2 | 2 | 2 | 2 | 2 | 1 | 2.8 |
| NM_005080_1282-1300 | 12 | 2 | 5 | 2 | 8 | 2 | 2 | 1 |
| NM_005080_1287-1305 | 6 | 2 | 3 | 2 | 10 | 2 | 1 | 2 |
| NM_005080_1289-1307 | 2 | 2 | 21 | 3 | 1 | 2 | 4 | 2.2 |
| NM_005080_1310-1328 | 1 | 2 | 3 | 2 | 3 | 2 | 1 | 2.2 |
| NM_005080_1330-1348 | 6 | 2 | 2 | 2 | 4 | 2 | 7 | 2 |
| NM_005080_1332-1350 | 2 | 2 | 8 | 3 | 1 | 2 | 12 | 3 |
| NM_005080_1333-1351 | 2 | 2 | 1 | 2 | 1 | 2 | 1 | 2 |
| NM_005080_1369-1387 | 4 | 2 | 3 | 2 | 4 | 2 | 4 | 2 |
| NM_005080_1370-1388 | 1 | 2 | 7 | 2 | 1 | 2 | 5 | 2 |
| NM_005080_1371-1389 | 4 | 2 | 2 | 2 | 8 | 2 | 1 | 1 |
| NM_005080_101-119 | 1 | 2 | 2 | 2 | 2 | 2 | 2 | 1 |
| NM_005080_1418-1436 | 2 | 2 | 1 | 1 | 3 | 2 | 11 | 2 |
| NM_005080_1419-1437 | 3 | 2 | 3 | 2 | 9 | 2 | 8 | 2.2 |
| NM_005080_1422-1440 | 6 | 2 | 11 | 3 | 1 | 2 | 6 | 3 |
| NM_005080_102-120 | 3 | 2 | 1 | 2 | 5 | 2 | 8 | 2 |
| NM_005080_1423-1441 | 6 | 2 | 4 | 3 | 4 | 2 | 6 | 3 |
| NM_005080_1425-1443 | 1 | 2 | 2 | 2 | 1 | 2 | 1 | 2 |
| NM_005080_1427-1445 | 5 | 2 | 1 | 2 | 11 | 2 | 1 | 2 |
| NM_005080_1428-1446 | 6 | 2 | 1 | 2.2 | 7 | 2 | 1 | 2 |
| NM_005080_1429-1447 | 1 | 2 | 5 | 3 | 1 | 2 | 3 | 3 |
| NM_005080_1432-1450 | 3 | 2 | 3 | 2 | 2 | 2 | 1 | 2.8 |
| NM_005080_1433-1451 | 3 | 2 | 4 | 2 | 4 | 2 | 6 | 2 |
| NM_005080_1435-1453 | 1 | 2 | 1 | 2 | 2 | 2 | 4 | 2 |
| NM_005080_1439-1457 | 1 | 2 | 1 | 2 | 2 | 2 | 4 | 2 |
| NM_005080_104-122 | 1 | 2 | 5 | 3 | 4 | 2 | 7 | 2 |
| NM_005080_1444-1462 | 3 | 2 | 4 | 2 | 1 | 2 | 2 | 2 |
| NM_005080_1445-1463 | 10 | 2 | 3 | 2 | 17 | 2 | 3 | 2 |
| NM_005080_1446-1464 | 8 | 2 | 2 | 2 | 18 | 2 | 1 | 1 |
| NM_005080_1447-1465 | 1 | 2 | 2 | 2.2 | 3 | 2 | 3 | 2 |
| NM_005080_1448-1466 | 2 | 2 | 1 | 2 | 2 | 2 | 5 | 2 |
| NM_005080_1451-1469 | 2 | 2 | 1 | 1 | 1 | 2 | 1 | 1 |
| NM_005080_1454-1472 | 2 | 2 | 4 | 2 | 4 | 2 | 4 | 2 |
| NM_005080_1458-1476 | 6 | 2 | 3 | 2 | 4 | 2 | 10 | 2 |
| NM_005080_1459-1477 | 1 | 2 | 3 | 2 | 3 | 2 | 1 | 1.2 |
| NM_005080_106-124 | 2 | 2 | 1 | 1.2 | 1 | 2 | 9 | 2.2 |
| NM_005080_1466-1484 | 1 | 2 | 2 | 2 | 2 | 2 | 2 | 2 |
| NM_005080_1486-1504 | 2 | 2 | 3 | 2 | 2 | 2 | 1 | 0 |
| NM_005080_1487-1505 | 2 | 2 | 3 | 2 | 2 | 2 | 1 | 1 |
| NM_005080_1489-1507 | 4 | 2 | 5 | 2 | 1 | 2 | 1 | 1 |

TABLE 10-continued

XBP-1 Human/Rhesus siRNA analysis

| | | | off target | | | | | |
|---|---|---|---|---|---|---|---|---|
| Oligo Name/ | | human | | | | rhesus | | |
| Location of Target | Anti- | Anti- | | | | | | |
| sequence from | sense | sense | Sense | Sense | Antisense | Antisense | Sense | Sense |
| 5' to 3' | Count | Score | Count | Score | Count | Score | Count | Score |
| NM_005080_1490-1508 | 3 | 2 | 2 | 2 | 6 | 2 | 4 | 2 |
| NM_005080_1491-1509 | 3 | 2 | 2 | 2 | 2 | 2 | 2 | 2.2 |
| NM_005080_109-127 | 5 | 2 | 1 | 1 | 4 | 2 | 2 | 1 |
| NM_005080_1497-1515 | 1 | 2 | 2 | 3.2 | 1 | 2 | 2 | 3 |
| NM_005080_1498-1516 | 2 | 2 | 2 | 2.2 | 4 | 2 | 1 | 2 |
| NM_005080_110-128 | 3 | 2 | 2 | 1 | 4 | 2 | 1 | 1 |
| NM_005080_1511-1529 | 2 | 2 | 10 | 2 | 3 | 2 | 8 | 2 |
| NM_005080_1513-1531 | 5 | 2 | 1 | 1 | 3 | 2 | 1 | 2.8 |
| NM_005080_1516-1534 | 1 | 2 | 1 | 2 | 1 | 2 | 2 | 2.2 |
| NM_005080_1517-1535 | 2 | 2 | 1 | 1 | 2 | 2 | 2 | 1 |
| NM_005080_1518-1536 | 4 | 2 | 2 | 2 | 2 | 2 | 3 | 2 |
| NM_005080_1547-1565 | 2 | 2 | 1 | 2 | 4 | 2 | 2 | 2 |
| NM_005080_1550-1568 | 5 | 2 | 2 | 2 | 4 | 2 | 5 | 2 |
| NM_005080_1551-1569 | 1 | 2 | 2 | 1.2 | 1 | 2 | 1 | 1.2 |
| NM_005080_1552-1570 | 4 | 2 | 1 | 1.2 | 4 | 2 | 1 | 1.2 |
| NM_005080_1554-1572 | 3 | 2 | 1 | 1 | 7 | 2 | 1 | 1.2 |
| NM_005080_1559-1577 | 5 | 2 | 1 | 2 | 7 | 2 | 1 | 2 |
| NM_005080_1560-1578 | 5 | 2 | 1 | 1 | 5 | 2 | 1 | 1 |
| NM_005080_1563-1581 | 5 | 2 | 1 | 1.2 | 18 | 2 | 1 | 1 |
| NM_005080_1565-1583 | 7 | 2 | 2 | 1.2 | 11 | 2 | 3 | 1.2 |
| NM_005080_1566-1584 | 6 | 2 | 1 | 1.2 | 9 | 2 | 9 | 1.2 |
| NM_005080_1570-1588 | 2 | 2 | 1 | 2 | 5 | 2 | 1 | 2.2 |
| NM_005080_1573-1591 | 2 | 2 | 9 | 2 | 1 | 2 | 5 | 2 |
| NM_005080_1578-1596 | 2 | 2 | 1 | 2 | 5 | 2 | 3 | 2 |
| NM_005080_1579-1597 | 3 | 2 | 4 | 2 | 4 | 2 | 3 | 2 |
| NM_005080_1580-1598 | 3 | 2 | 2 | 2 | 4 | 2 | 5 | 2 |
| NM_005080_1581-1599 | 3 | 2 | 5 | 2 | 2 | 2 | 5 | 2 |
| NM_005080_1583-1601 | 4 | 2 | 4 | 2 | 4 | 2 | 1 | 1 |
| NM_005080_1584-1602 | 7 | 2 | 7 | 2 | 9 | 2 | 1 | 0 |
| NM_005080_1586-1604 | 4 | 2 | 1 | 1 | 3 | 2 | 2 | 1 |
| NM_005080_1589-1607 | 1 | 2 | 3 | 2 | 1 | 2 | 1 | 2 |
| NM_005080_1590-1608 | 4 | 2 | 9 | 3 | 4 | 2 | 1 | 2 |
| NM_005080_1595-1613 | 1 | 2 | 10 | 2 | 1 | 2 | 6 | 2 |
| NM_005080_1616-1634 | 3 | 2 | 1 | 2 | 1 | 2 | 2 | 2 |
| NM_005080_1617-1635 | 2 | 2 | 1 | 1 | 1 | 2 | 3 | 1 |
| NM_005080_1643-1661 | 2 | 2 | 5 | 2 | 3 | 2 | 1 | 1.2 |
| NM_005080_1645-1663 | 1 | 2 | 2 | 1 | 1 | 2 | 1 | 1 |
| NM_005080_1646-1664 | 3 | 2 | 5 | 1 | 3 | 2 | 1 | 1 |
| NM_005080_1647-1665 | 4 | 2 | 7 | 2 | 1 | 2 | 4 | 2 |
| NM_005080_1648-1666 | 7 | 2 | 4 | 2 | 5 | 2 | 10 | 2 |
| NM_005080_1649-1667 | 2 | 2 | 9 | 2 | 5 | 2 | 14 | 2 |
| NM_005080_1679-1697 | 5 | 2 | 2 | 2.2 | 5 | 2 | 2 | 2.2 |
| NM_005080_1680-1698 | 2 | 2 | 1 | 2.2 | 3 | 2 | 1 | 2.2 |
| NM_005080_1681-1699 | 7 | 2 | 1 | 2 | 7 | 2 | 1 | 3 |
| NM_005080_1682-1700 | 12 | 2 | 1 | 2 | 19 | 2 | 1 | 2.2 |
| NM_005080_1683-1701 | 6 | 2 | 15 | 3 | 7 | 2 | 3 | 3 |
| NM_005080_1684-1702 | 5 | 2 | 3 | 3 | 6 | 2 | 1 | 3 |
| NM_005080_1687-1705 | 4 | 2 | 4 | 1 | 2 | 2 | 1 | 1 |
| NM_005080_1709-1727 | 1 | 2 | 6 | 2 | 1 | 2 | 5 | 2 |
| NM_005080_1710-1728 | 3 | 2 | 6 | 2 | 2 | 2 | 5 | 2 |
| NM_005080_1711-1729 | 1 | 2 | 1 | 1 | 2 | 2 | 1 | 1.2 |
| NM_005080_1712-1730 | 10 | 2 | 1 | 2 | 10 | 2 | 1 | 2.2 |
| NM_005080_1714-1732 | 1 | 2 | 1 | 2 | 1 | 2 | 2 | 1 |
| NM_005080_1715-1733 | 2 | 2 | 1 | 2 | 3 | 2 | 1 | 1 |
| NM_005080_1717-1735 | 4 | 2 | 4 | 3 | 2 | 2 | 1 | 2.2 |
| NM_005080_1719-1737 | 7 | 2 | 1 | 2 | 13 | 2 | 2 | 2 |
| NM_005080_1721-1739 | 1 | 2 | 8 | 3 | 1 | 2 | 5 | 3 |
| NM_005080_1722-1740 | 4 | 2 | 10 | 3 | 2 | 2 | 6 | 3 |
| NM_005080_1723-1741 | 1 | 2 | 1 | 2 | 3 | 2 | 4 | 2.2 |
| NM_005080_1726-1744 | 2 | 2 | 1 | 2.8 | 11 | 2 | 1 | 2.2 |
| NM_005080_1727-1745 | 3 | 2 | 1 | 2 | 10 | 2 | 17 | 3 |
| NM_005080_1728-1746 | 10 | 2 | 2 | 2 | 3 | 2 | 1 | 2 |
| NM_005080_1729-1747 | 7 | 2 | 1 | 1 | 4 | 2 | 3 | 1 |
| NM_005080_1736-1754 | 10 | 2 | 1 | 2 | 2 | 2 | 4 | 2 |
| NM_005080_1739-1757 | 1 | 2 | 8 | 2 | 1 | 2 | 8 | 2 |
| NM_005080_1746-1764 | 2 | 2 | 4 | 2.2 | 1 | 2 | 1 | 2 |
| NM_005080_1747-1765 | 3 | 2 | 3 | 3 | 1 | 2 | 1 | 2.2 |
| NM_005080_1749-1767 | 3 | 2 | 1 | 2.2 | 3 | 2 | 2 | 3 |

TABLE 10-continued

XBP-1 Human/Rhesus siRNA analysis

| | off target | | | | | | | |
|---|---|---|---|---|---|---|---|---|
| | human | | | | rhesus | | | |
| Oligo Name/ Location of Target sequence from 5' to 3' | Anti-sense Count | Anti-sense Score | Sense Count | Sense Score | Antisense Count | Antisense Score | Sense Count | Sense Score |
| NM_005080_1750-1768 | 6 | 2 | 1 | 2 | 13 | 2 | 2 | 2 |
| NM_005080_1751-1769 | 5 | 2 | 3 | 2 | 14 | 2 | 2 | 2 |
| NM_005080_1752-1770 | 3 | 2 | 6 | 2 | 1 | 2 | 1 | 2 |
| NM_005080_1753-1771 | 1 | 2 | 7 | 2 | 3 | 2 | 1 | 2 |
| NM_005080_1755-1773 | 7 | 2 | 2 | 2 | 1 | 2 | 1 | 2 |
| NM_005080_1758-1776 | 7 | 2 | 7 | 2 | 12 | 2 | 3 | 2 |
| NM_005080_1781-1799 | 1 | 2 | 1 | 1.2 | 1 | 2 | 7 | 2 |
| NM_005080_1782-1800 | 1 | 2 | 1 | 2 | 3 | 2 | 2 | 2 |
| NM_005080_1784-1802 | 2 | 2 | 3 | 3 | 1 | 2 | 1 | 2 |
| NM_005080_1785-1803 | 4 | 2 | 1 | 2.2 | 2 | 2 | 1 | 2.2 |
| NM_005080_1788-1806 | 1 | 2 | 3 | 3 | 7 | 2 | 3 | 2.2 |
| NM_005080_1792-1810 | 2 | 2 | 1 | 2.8 | 1 | 2 | 2 | 2.8 |
| NM_005080_1793-1811 | 3 | 2 | 2 | 2 | 1 | 2 | 1 | 2.8 |
| NM_005080_1795-1813 | 5 | 2 | 1 | 2.4 | 1 | 2 | 2 | 2 |
| NM_005080_1798-1816 | 1 | 2 | 7 | 2 | 1 | 2 | 5 | 2 |
| NM_005080_1799-1817 | 1 | 2 | 4 | 2 | 1 | 2 | 5 | 2 |
| NM_005080_1800-1818 | 5 | 2 | 3 | 2 | 4 | 2 | 1 | 2 |
| NM_005080_1801-1819 | 2 | 2 | 3 | 2.2 | 4 | 2 | 2 | 1 |
| NM_005080_146-164 | 4 | 2 | 2 | 1 | 1 | 2 | 1 | 1 |
| NM_005080_147-165 | 2 | 2 | 2 | 1 | 1 | 2 | 23 | 2 |
| NM_005080_148-166 | 1 | 2 | 3 | 2 | 1 | 2 | 4 | 2 |
| NM_005080_149-167 | 1 | 2 | 1 | 1.2 | 2 | 2 | 1 | 1.2 |
| NM_005080_155-173 | 5 | 2 | 3 | 2 | 2 | 2 | 3 | 1 |
| NM_005080_157-175 | 7 | 2 | 7 | 2 | 5 | 2 | 11 | 2 |
| NM_005080_158-176 | 4 | 2 | 7 | 2 | 6 | 2 | 1 | 1 |
| NM_005080_159-177 | 4 | 2 | 5 | 2.2 | 3 | 2 | 1 | 1.2 |
| NM_005080_188-206 | 4 | 2 | 1 | 1 | 8 | 2 | 2 | 1 |
| NM_005080_189-207 | 1 | 2 | 1 | 1 | 2 | 2 | 3 | 1 |
| NM_005080_195-213 | 4 | 2 | 2 | 1 | 5 | 2 | 6 | 2 |
| NM_005080_196-214 | 4 | 2 | 2 | 1 | 2 | 2 | 2 | 2.2 |
| NM_005080_197-215 | 2 | 2 | 3 | 2 | 1 | 2 | 1 | 2.2 |
| NM_005080_198-216 | 4 | 2 | 1 | 2 | 4 | 2 | 2 | 2 |
| NM_005080_205-223 | 5 | 2 | 6 | 1 | 6 | 2 | 1 | 0 |
| NM_005080_206-224 | 7 | 2 | 8 | 1 | 1 | 2 | 10 | 1 |
| NM_005080_207-225 | 5 | 2 | 3 | 1 | 4 | 2 | 3 | 1 |
| NM_005080_211-229 | 2 | 2 | 15 | 2 | 2 | 2 | 3 | 2 |
| NM_005080_250-268 | 16 | 2 | 8 | 2 | 6 | 2 | 1 | 0 |
| NM_005080_256-274 | 11 | 2 | 1 | 0 | 7 | 2 | 2 | 0 |
| NM_005080_263-281 | 6 | 2 | 4 | 2.2 | 4 | 2 | 2 | 1 |
| NM_005080_264-282 | 5 | 2 | 1 | 2.2 | 4 | 2 | 2 | 2 |
| NM_005080_285-303 | 2 | 2 | 3 | 3 | 3 | 2 | 14 | 3 |
| NM_005080_286-304 | 8 | 2 | 1 | 2 | 9 | 2 | 2 | 2 |
| NM_005080_287-305 | 8 | 2 | 1 | 0 | 5 | 2 | 1 | 0 |
| NM_005080_294-312 | 5 | 2 | 2 | 2 | 1 | 2 | 1 | 1 |
| NM_005080_295-313 | 1 | 2 | 1 | 0 | 1 | 2 | 3 | 2 |
| NM_005080_296-314 | 1 | 2 | 2 | 1.2 | 1 | 2 | 2 | 2.2 |
| NM_005080_298-316 | 1 | 2 | 1 | 2.2 | 4 | 2 | 3 | 2 |
| NM_005080_303-321 | 1 | 2 | 1 | 2 | 1 | 2 | 1 | 2 |
| NM_005080_332-350 | 8 | 2 | 1 | 2 | 11 | 2 | 1 | 2 |
| NM_005080_339-357 | 3 | 2 | 1 | 1 | 1 | 2 | 1 | 1 |
| NM_005080_340-358 | 3 | 2 | 2 | 2 | 2 | 2 | 1 | 2 |
| NM_005080_345-363 | 1 | 2 | 5 | 2.2 | 6 | 2 | 1 | 2.2 |
| NM_005080_346-364 | 2 | 2 | 5 | 3 | 1 | 2 | 1 | 3 |
| NM_005080_348-366 | 1 | 2 | 3 | 2 | 1 | 2 | 2 | 2 |
| NM_005080_349-367 | 4 | 2 | 5 | 2 | 1 | 2 | 8 | 2 |
| NM_005080_352-370 | 3 | 2 | 3 | 2.2 | 6 | 2 | 3 | 2.2 |
| NM_005080_353-371 | 3 | 2 | 1 | 2.2 | 2 | 2 | 1 | 2.2 |
| NM_005080_354-372 | 8 | 2 | 7 | 2 | 12 | 2 | 4 | 2 |
| NM_005080_355-373 | 6 | 2 | 1 | 2 | 3 | 2 | 1 | 3 |
| NM_005080_361-379 | 2 | 2 | 2 | 1 | 5 | 2 | 1 | 1 |
| NM_005080_366-384 | 2 | 2 | 2 | 2 | 4 | 2 | 12 | 2.2 |
| NM_005080_369-387 | 9 | 2 | 3 | 2.2 | 4 | 2 | 6 | 2 |
| NM_005080_370-388 | 9 | 2 | 2 | 2 | 13 | 2 | 6 | 2 |
| NM_005080_372-390 | 3 | 2 | 1 | 2 | 1 | 2 | 1 | 2.2 |
| NM_005080_376-394 | 2 | 2 | 1 | 1 | 2 | 2 | 1 | 1 |
| NM_005080_381-399 | 8 | 2 | 2 | 2.2 | 5 | 2 | 1 | 1 |
| NM_005080_384-402 | 2 | 2 | 4 | 2.2 | 3 | 2 | 8 | 2 |
| NM_005080_388-406 | 1 | 2 | 1 | 1 | 1 | 2 | 1 | 1 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Anti-sense Count | Anti-sense Score | Sense Count | Sense Score | Antisense Count | Antisense Score | Sense Count | Sense Score |
| NM_005080_392-410 | 1 | 2 | 1 | 2.2 | 1 | 2 | 1 | 2.2 |
| NM_005080_394-412 | 1 | 2 | 2 | 3 | 1 | 2 | 9 | 3 |
| NM_005080_396-414 | 1 | 2 | 2 | 2 | 2 | 2 | 2 | 3 |
| NM_005080_400-418 | 6 | 2 | 3 | 0 | 18 | 2 | 1 | 0 |
| NM_005080_421-439 | 2 | 2 | 9 | 2.2 | 1 | 2 | 9 | 1.2 |
| NM_005080_422-440 | 1 | 2 | 1 | 2 | 1 | 2 | 1 | 1 |
| NM_005080_423-441 | 1 | 2 | 1 | 2 | 1 | 2 | 1 | 1 |
| NM_005080_425-443 | 3 | 2 | 6 | 3 | 7 | 2 | 2 | 2 |
| NM_005080_428-446 | 4 | 2 | 1 | 2.2 | 4 | 2 | 2 | 2.2 |
| NM_005080_429-447 | 3 | 2 | 4 | 2.8 | 3 | 2 | 1 | 2 |
| NM_005080_432-450 | 4 | 2 | 5 | 2 | 1 | 2 | 1 | 2 |
| NM_005080_433-451 | 10 | 2 | 5 | 2 | 5 | 2 | 1 | 2 |
| NM_005080_434-452 | 5 | 2 | 3 | 2.2 | 3 | 2 | 4 | 1 |
| NM_005080_435-453 | 6 | 2 | 2 | 3 | 4 | 2 | 4 | 1 |
| NM_005080_436-454 | 4 | 2 | 1 | 2 | 7 | 2 | 4 | 2.2 |
| NM_005080_459-477 | 2 | 2 | 2 | 2.2 | 3 | 2 | 4 | 2.2 |
| NM_005080_460-478 | 1 | 2 | 5 | 3 | 2 | 2 | 4 | 2 |
| NM_005080_462-480 | 1 | 2 | 1 | 2 | 2 | 2 | 2 | 2 |
| NM_005080_486-504 | 5 | 2 | 1 | 1 | 3 | 2 | 1 | 1 |
| NM_005080_510-528 | 3 | 2 | 1 | 1 | 4 | 2 | 9 | 2 |
| NM_005080_513-531 | 2 | 2 | 2 | 2 | 1 | 2 | 1 | 2 |
| NM_005080_514-532 | 3 | 2 | 10 | 2 | 8 | 2 | 1 | 0 |
| NM_005080_515-533 | 1 | 2 | 7 | 2 | 3 | 2 | 1 | 0 |
| NM_005080_516-534 | 4 | 2 | 1 | 0 | 7 | 2 | 1 | 0 |
| NM_005080_520-538 | 1 | 2 | 3 | 1 | 13 | 2 | 3 | 2 |
| NM_005080_521-539 | 2 | 2 | 1 | 1 | 11 | 2 | 2 | 2 |
| NM_005080_523-541 | 6 | 2 | 2 | 2 | 2 | 2 | 2 | 2 |
| NM_005080_578-596 | 2 | 2 | 2 | 2 | 6 | 2 | 1 | 2 |
| NM_005080_581-599 | 4 | 2 | 1 | 1 | 2 | 2 | 1 | 1 |
| NM_005080_582-600 | 3 | 2 | 1 | 2 | 4 | 2 | 1 | 2 |
| NM_005080_583-601 | 4 | 2 | 2 | 2 | 17 | 2 | 1 | 2 |
| NM_005080_584-602 | 5 | 2 | 2 | 2 | 17 | 2 | 1 | 2 |
| NM_005080_585-603 | 3 | 2 | 2 | 2 | 4 | 2 | 2 | 2 |
| NM_005080_586-604 | 1 | 2 | 2 | 2 | 1 | 2 | 1 | 2.2 |
| NM_005080_587-605 | 3 | 2 | 6 | 3 | 4 | 2 | 1 | 2.2 |
| NM_005080_588-606 | 3 | 2 | 1 | 2 | 3 | 2 | 24 | 3 |
| NM_005080_589-607 | 2 | 2 | 1 | 1 | 3 | 2 | 1 | 1 |
| NM_005080_590-608 | 1 | 2 | 1 | 2 | 3 | 2 | 1 | 2 |
| NM_005080_591-609 | 3 | 2 | 1 | 2.2 | 5 | 2 | 7 | 2.2 |
| NM_005080_597-615 | 2 | 2 | 1 | 2.2 | 1 | 2 | 5 | 2.2 |
| NM_005080_600-618 | 1 | 2 | 1 | 2.2 | 3 | 2 | 9 | 2 |
| NM_005080_603-621 | 4 | 2 | 3 | 2 | 4 | 2 | 3 | 2 |
| NM_005080_619-637 | 3 | 2 | 4 | 3.2 | 1 | 2 | 7 | 3.2 |
| NM_005080_620-638 | 5 | 2 | 2 | 4.2 | 1 | 2 | 1 | 3 |
| NM_005080_622-640 | 1 | 2 | 1 | 2.2 | 2 | 2 | 1 | 2.2 |
| NM_005080_623-641 | 3 | 2 | 1 | 3 | 1 | 2 | 2 | 3 |
| NM_005080_624-642 | 2 | 2 | 1 | 3 | 1 | 2 | 1 | 2 |
| NM_005080_625-643 | 8 | 2 | 4 | 2.8 | 19 | 2 | 2 | 2 |
| NM_005080_626-644 | 9 | 2 | 1 | 2.8 | 5 | 2 | 1 | 2 |
| NM_005080_629-647 | 2 | 2 | 4 | 1 | 1 | 2 | 4 | 1 |
| NM_005080_632-650 | 1 | 2 | 2 | 0 | 3 | 2 | 7 | 1 |
| NM_005080_634-652 | 6 | 2 | 2 | 1 | 4 | 2 | 7 | 2 |
| NM_005080_637-655 | 2 | 2 | 2 | 2 | 2 | 2 | 1 | 2 |
| NM_005080_638-656 | 2 | 2 | 5 | 3 | 8 | 2 | 3 | 3 |
| NM_005080_639-657 | 1 | 2 | 1 | 2 | 1 | 2 | 1 | 2 |
| NM_005080_642-660 | 2 | 2 | 1 | 1 | 2 | 2 | 2 | 2 |
| NM_005080_643-661 | 1 | 2 | 3 | 2 | 3 | 2 | 4 | 3 |
| NM_005080_644-662 | 2 | 2 | 4 | 3 | 3 | 2 | 6 | 2.2 |
| NM_005080_646-664 | 2 | 2 | 2 | 1 | 5 | 2 | 1 | 1 |
| NM_005080_649-667 | 1 | 2 | 2 | 2 | 1 | 2 | 1 | 2 |
| NM_005080_650-668 | 1 | 2 | 1 | 2 | 1 | 2 | 1 | 3 |
| NM_005080_653-671 | 2 | 2 | 2 | 2 | 2 | 2 | 2 | 2 |
| NM_005080_658-676 | 2 | 2 | 2 | 1 | 1 | 2 | 1 | 1 |
| NM_005080_659-677 | 2 | 2 | 2 | 2 | 2 | 2 | 1 | 2 |
| NM_005080_660-678 | 1 | 2 | 6 | 2 | 2 | 2 | 1 | 1 |
| NM_005080_663-681 | 6 | 2 | 5 | 2 | 2 | 2 | 2 | 2 |
| NM_005080_664-682 | 4 | 2 | 4 | 2 | 1 | 2 | 9 | 2.2 |
| NM_005080_668-686 | 6 | 2 | 2 | 2.2 | 3 | 2 | 4 | 2.2 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target sequence from 5' to 3' | Anti-sense Count | Anti-sense Score | Sense Count | Sense Score | Antisense Count | Antisense Score | Sense Count | Sense Score |
| NM_005080_671-689 | 1 | 2 | 2 | 1 | 10 | 2 | 11 | 2 |
| NM_005080_676-694 | 3 | 2 | 1 | 2 | 4 | 2 | 9 | 3 |
| NM_005080_677-695 | 2 | 2 | 1 | 2 | 1 | 2 | 2 | 2 |
| NM_005080_679-697 | 1 | 2 | 1 | 2 | 1 | 2 | 1 | 2 |
| NM_005080_680-698 | 2 | 2 | 5 | 3 | 1 | 2 | 19 | 3.2 |
| NM_005080_682-700 | 7 | 2 | 2 | 2 | 4 | 2 | 1 | 2 |
| NM_005080_687-705 | 1 | 2 | 3 | 1 | 2 | 2 | 6 | 1 |
| NM_005080_689-707 | 2 | 2 | 1 | 2 | 3 | 2 | 2 | 2 |
| NM_005080_695-713 | 2 | 2 | 1 | 2 | 1 | 2 | 1 | 2 |
| NM_005080_696-714 | 3 | 2 | 1 | 1 | 1 | 2 | 1 | 2 |
| NM_005080_698-716 | 11 | 2 | 1 | 2 | 11 | 2 | 1 | 2 |
| NM_005080_731-749 | 1 | 2 | 1 | 1 | 1 | 2 | 1 | 2.2 |
| NM_005080_732-750 | 1 | 2 | 2 | 2 | 1 | 2 | 1 | 2 |
| NM_005080_733-751 | 1 | 2 | 1 | 2.8 | 1 | 2 | 1 | 2 |
| NM_005080_736-754 | 1 | 2 | 2 | 2 | 4 | 2 | 4 | 2 |
| NM_005080_737-755 | 1 | 2 | 6 | 3 | 4 | 2 | 1 | 2 |
| NM_005080_738-756 | 2 | 2 | 2 | 2.2 | 7 | 2 | 3 | 2.2 |
| NM_005080_740-758 | 4 | 2 | 7 | 3 | 5 | 2 | 1 | 3 |
| NM_005080_741-759 | 3 | 2 | 5 | 3 | 1 | 2 | 1 | 3 |
| NM_005080_742-760 | 1 | 2 | 4 | 3 | 3 | 2 | 1 | 3 |
| NM_005080_743-761 | 4 | 2 | 2 | 2 | 6 | 2 | 5 | 3 |
| NM_005080_748-766 | 6 | 2 | 1 | 1.2 | 4 | 2 | 2 | 2 |
| NM_005080_749-767 | 5 | 2 | 2 | 2 | 2 | 2 | 2 | 2 |
| NM_005080_750-768 | 4 | 2 | 3 | 2 | 2 | 2 | 2 | 2 |
| NM_005080_751-769 | 4 | 2 | 1 | 2 | 1 | 2 | 1 | 2.2 |
| NM_005080_752-770 | 7 | 2 | 2 | 2 | 3 | 2 | 1 | 2 |
| NM_005080_756-774 | 3 | 2 | 2 | 2 | 3 | 2 | 8 | 3 |
| NM_005080_758-776 | 1 | 2 | 1 | 2 | 1 | 2 | 1 | 1 |
| NM_005080_759-777 | 4 | 2 | 2 | 2 | 4 | 2 | 2 | 2 |
| NM_005080_760-778 | 1 | 2 | 1 | 2 | 3 | 2 | 1 | 2 |
| NM_005080_761-779 | 5 | 2 | 1 | 2.2 | 3 | 2 | 1 | 2 |
| NM_005080_762-780 | 7 | 2 | 2 | 2.2 | 1 | 2 | 1 | 2.2 |
| NM_005080_767-785 | 5 | 2 | 4 | 2 | 5 | 2 | 1 | 1 |
| NM_005080_769-787 | 4 | 2 | 1 | 1.2 | 7 | 2 | 5 | 2 |
| NM_005080_773-791 | 14 | 2 | 2 | 1 | 7 | 2 | 3 | 1 |
| NM_005080_779-797 | 6 | 2 | 6 | 2 | 21 | 2 | 9 | 2 |
| NM_005080_786-804 | 1 | 2 | 1 | 1.2 | 1 | 2 | 1 | 1 |
| NM_005080_787-805 | 2 | 2 | 2 | 2 | 1 | 2 | 2 | 2 |
| NM_005080_789-807 | 1 | 2 | 4 | 2.2 | 1 | 2 | 6 | 2.2 |
| NM_005080_793-811 | 4 | 2 | 1 | 2 | 11 | 2 | 1 | 2 |
| NM_005080_795-813 | 1 | 2 | 4 | 3 | 1 | 2 | 1 | 3 |
| NM_005080_797-815 | 3 | 2 | 5 | 3.2 | 3 | 2 | 1 | 2 |
| NM_005080_798-816 | 4 | 2 | 2 | 2.8 | 1 | 2 | 1 | 1 |
| NM_005080_800-818 | 5 | 2 | 2 | 1 | 3 | 2 | 1 | 1 |
| NM_005080_804-822 | 9 | 2 | 2 | 1 | 8 | 2 | 2 | 0 |
| NM_005080_806-824 | 11 | 2 | 3 | 2 | 11 | 2 | 5 | 2 |
| NM_005080_807-825 | 2 | 2 | 4 | 2.2 | 1 | 2 | 2 | 2 |
| NM_005080_808-826 | 2 | 2 | 1 | 2.2 | 1 | 2 | 1 | 2.2 |
| NM_005080_809-827 | 3 | 2 | 7 | 2 | 4 | 2 | 10 | 2 |
| NM_005080_810-828 | 1 | 2 | 5 | 2 | 3 | 2 | 2 | 2 |
| NM_005080_811-829 | 1 | 2 | 1 | 1 | 1 | 2 | 1 | 1 |
| NM_005080_813-831 | 6 | 2 | 2 | 2 | 7 | 2 | 2 | 2 |
| NM_005080_814-832 | 1 | 2 | 1 | 2 | 1 | 2 | 1 | 2 |
| NM_005080_818-836 | 4 | 2 | 1 | 2.2 | 2 | 2 | 1 | 2.2 |
| NM_005080_820-838 | 1 | 2 | 5 | 2 | 1 | 2 | 1 | 2 |
| NM_005080_837-855 | 1 | 2 | 3 | 2.8 | 6 | 2 | 1 | 2.2 |
| NM_005080_844-862 | 4 | 2 | 3 | 2 | 13 | 2 | 1 | 2.2 |
| NM_005080_872-890 | 2 | 2 | 1 | 3 | 4 | 2 | 1 | 3 |
| NM_005080_873-891 | 1 | 2 | 4 | 2 | 3 | 2 | 1 | 2 |
| NM_005080_874-892 | 4 | 2 | 7 | 3.2 | 2 | 2 | 1 | 2.4 |
| NM_005080_876-894 | 6 | 2 | 1 | 2.2 | 4 | 2 | 4 | 2.2 |
| NM_005080_889-907 | 1 | 2 | 2 | 2.2 | 1 | 2 | 2 | 2 |
| NM_005080_890-908 | 2 | 2 | 1 | 3 | 3 | 2 | 1 | 2 |
| NM_005080_897-915 | 1 | 2 | 2 | 3 | 5 | 2 | 4 | 3 |
| NM_005080_898-916 | 1 | 2 | 2 | 3 | 1 | 2 | 7 | 3 |
| NM_005080_901-919 | 4 | 2 | 3 | 2.2 | 3 | 2 | 2 | 2.2 |
| NM_005080_903-921 | 1 | 2 | 2 | 2 | 4 | 2 | 1 | 1 |
| NM_005080_904-922 | 1 | 2 | 3 | 2.2 | 4 | 2 | 1 | 2 |

TABLE 10-continued

XBP-1 Human/Rhesus siRNA analysis

| | off target | | | | | | | |
|---|---|---|---|---|---|---|---|---|
| Oligo Name/ | human | | | | | | | |
| Location of Target | Anti- | Anti- | | | rhesus | | | |
| sequence from 5' to 3' | sense Count | sense Score | Sense Count | Sense Score | Antisense Count | Antisense Score | Sense Count | Sense Score |
| NM_005080_906-924 | 2 | 2 | 4 | 3 | 2 | 2 | 5 | 3 |
| NM_005080_907-925 | 1 | 2 | 4 | 3 | 2 | 2 | 3 | 3 |
| NM_005080_910-928 | 5 | 2 | 2 | 2 | 4 | 2 | 1 | 1 |
| NM_005080_913-931 | 4 | 2 | 1 | 3.2 | 3 | 2 | 3 | 3.2 |
| NM_005080_916-934 | 3 | 2 | 7 | 3 | 3 | 2 | 4 | 3 |
| NM_005080_918-936 | 1 | 2 | 2 | 3 | 1 | 2 | 3 | 3 |
| NM_005080_919-937 | 3 | 2 | 3 | 3 | 1 | 2 | 4 | 3 |
| NM_005080_920-938 | 2 | 2 | 2 | 2 | 2 | 2 | 2 | 2 |
| NM_005080_922-940 | 5 | 2 | 4 | 2 | 9 | 2 | 3 | 2.2 |
| NM_005080_923-941 | 3 | 2 | 3 | 2 | 14 | 2 | 1 | 2 |
| NM_005080_929-947 | 8 | 2 | 8 | 2 | 5 | 2 | 5 | 2 |
| NM_005080_930-948 | 6 | 2 | 4 | 2 | 5 | 2 | 1 | 2 |
| NM_005080_931-949 | 3 | 2 | 1 | 2.2 | 2 | 2 | 10 | 3 |
| NM_005080_932-950 | 1 | 2 | 3 | 2 | 4 | 2 | 2 | 2 |
| NM_005080_933-951 | 5 | 2 | 10 | 3 | 2 | 2 | 4 | 2 |
| NM_005080_934-952 | 1 | 2 | 2 | 2.2 | 6 | 2 | 5 | 2 |
| NM_005080_935-953 | 2 | 2 | 3 | 2 | 7 | 2 | 1 | 2 |
| NM_005080_936-954 | 4 | 2 | 8 | 3 | 2 | 2 | 7 | 3 |
| NM_005080_938-956 | 1 | 2 | 1 | 2 | 1 | 2 | 1 | 2 |
| NM_005080_941-959 | 3 | 2 | 2 | 2 | 5 | 2 | 2 | 2 |
| NM_005080_942-960 | 1 | 2 | 1 | 2 | 1 | 2 | 1 | 1.2 |
| NM_005080_943-961 | 2 | 2 | 1 | 2 | 2 | 2 | 1 | 2 |
| NM_005080_944-962 | 3 | 2 | 3 | 3 | 6 | 2 | 1 | 2.2 |
| NM_005080_946-964 | 1 | 2 | 2 | 3 | 2 | 2 | 9 | 3 |
| NM_005080_947-965 | 1 | 2 | 2 | 2 | 2 | 2 | 4 | 2 |
| NM_005080_948-966 | 3 | 2 | 1 | 2.2 | 4 | 2 | 4 | 2.2 |
| NM_005080_949-967 | 1 | 2 | 1 | 2 | 3 | 2 | 4 | 2 |
| NM_005080_955-973 | 5 | 2 | 2 | 2 | 4 | 2 | 3 | 2 |
| NM_005080_956-974 | 2 | 2 | 9 | 2 | 2 | 2 | 4 | 2 |
| NM_005080_957-975 | 2 | 2 | 3 | 2 | 1 | 2 | 2 | 2.2 |
| NM_005080_960-978 | 7 | 2 | 2 | 1 | 2 | 2 | 1 | 1 |
| NM_005080_961-979 | 2 | 2 | 2 | 2 | 1 | 2 | 3 | 2 |
| NM_005080_965-983 | 2 | 2 | 1 | 1 | 2 | 2 | 3 | 2 |
| NM_005080_967-985 | 8 | 2 | 1 | 2 | 3 | 2 | 1 | 2 |
| NM_005080_968-986 | 12 | 2 | 1 | 2.2 | 13 | 2 | 2 | 2.2 |
| NM_005080_971-989 | 3 | 2 | 12 | 3 | 7 | 2 | 1 | 2 |
| NM_005080_972-990 | 8 | 2 | 3 | 2 | 23 | 2 | 2 | 2 |
| NM_005080_973-991 | 6 | 2 | 1 | 1 | 8 | 2 | 1 | 2 |
| NM_005080_980-998 | 8 | 2 | 3 | 2.2 | 7 | 2 | 1 | 2 |
| NM_005080_984-1002 | 14 | 2 | 3 | 2 | 18 | 2 | 1 | 2 |
| NM_005080_986-1004 | 1 | 2 | 2 | 2 | 5 | 2 | 2 | 2 |
| NM_005080_1023-1041 | 1 | 2 | 1 | 1.2 | 1 | 1.2 | 1 | 1.2 |
| NM_005080_1151-1169 | 2 | 2 | 3 | 2 | 6 | 1.2 | 5 | 2 |
| NM_005080_1367-1385 | 9 | 2 | 1 | 2.2 | 1 | 1.2 | 4 | 2.8 |
| NM_005080_1414-1432 | 2 | 2 | 1 | 1 | 1 | 1.2 | 7 | 2 |
| NM_005080_1415-1433 | 7 | 2 | 1 | 1 | 1 | 1.2 | 4 | 1 |
| NM_005080_1674-1692 | 3 | 2 | 8 | 3 | 1 | 1.2 | 3 | 2 |
| NM_005080_1675-1693 | 1 | 2 | 2 | 2 | 1 | 1.2 | 6 | 2 |
| NM_005080_330-348 | 4 | 2 | 6 | 2 | 1 | 1.2 | 2 | 2 |
| NM_005080_333-351 | 8 | 2 | 2 | 1 | 2 | 1.2 | 4 | 2 |
| NM_005080_592-610 | 3 | 2 | 3 | 2 | 1 | 1.2 | 1 | 2.2 |
| NM_005080_665-683 | 3 | 2 | 2 | 2 | 3 | 1.2 | 1 | 2.8 |
| NM_005080_815-833 | 3 | 2 | 2 | 2 | 2 | 1.2 | 1 | 2 |
| NM_005080_1029-1047 | 1 | 2 | 3 | 2.2 | 2 | 1 | 9 | 3 |
| NM_005080_1077-1095 | 9 | 2 | 1 | 3 | 1 | 1 | 1 | 3.2 |
| NM_005080_1222-1240 | 3 | 2 | 2 | 1 | 1 | 1 | 4 | 1 |
| NM_005080_1285-1303 | 13 | 2 | 1 | 2 | 1 | 1 | 1 | 2 |
| NM_005080_1334-1352 | 2 | 2 | 1 | 3 | 1 | 1 | 1 | 2 |
| NM_005080_1335-1353 | 4 | 2 | 1 | 2.2 | 1 | 1 | 6 | 3 |
| NM_005080_1436-1454 | 3 | 2 | 4 | 2 | 1 | 1 | 2 | 2 |
| NM_005080_1449-1467 | 3 | 2 | 3 | 3 | 1 | 1 | 9 | 3 |
| NM_005080_1450-1468 | 1 | 2 | 1 | 2.2 | 1 | 1 | 4 | 2.2 |
| NM_005080_114-132 | 13 | 2 | 1 | 0 | 1 | 1 | 7 | 2 |
| NM_005080_1555-1573 | 2 | 2 | 2 | 1 | 1 | 1 | 1 | 1 |
| NM_005080_1556-1574 | 5 | 2 | 1 | 1 | 1 | 1 | 2 | 2 |
| NM_005080_1561-1579 | 5 | 2 | 2 | 1 | 1 | 1 | 7 | 1 |
| NM_005080_1562-1580 | 7 | 2 | 1 | 1 | 1 | 1 | 1 | 1 |
| NM_005080_1569-1587 | 1 | 2 | 2 | 2 | 5 | 1 | 4 | 2.2 |

TABLE 10-continued

XBP-1 Human/Rhesus siRNA analysis

| Oligo Name/ Location of Target sequence from 5' to 3' | off target | | | | | | | |
|---|---|---|---|---|---|---|---|---|
| | human | | | | rhesus | | | |
| | Antisense Count | Antisense Score | Sense Count | Sense Score | Antisense Count | Antisense Score | Sense Count | Sense Score |
| NM_005080_1588-1606 | 2 | 2 | 2 | 1 | 1 | 1 | 1 | 1 |
| NM_005080_1640-1658 | 1 | 2 | 2 | 2 | 1 | 1 | 3 | 2 |
| NM_005080_1641-1659 | 2 | 2 | 1 | 2 | 1 | 1 | 1 | 2 |
| NM_005080_1642-1660 | 5 | 2 | 2 | 2 | 2 | 1 | 1 | 2 |
| NM_005080_1650-1668 | 1 | 2 | 4 | 2 | 1 | 1 | 4 | 2 |
| NM_005080_1686-1704 | 6 | 2 | 1 | 2.2 | 1 | 1 | 2 | 2.2 |
| NM_005080_1745-1763 | 1 | 2 | 1 | 2 | 1 | 1 | 1 | 2 |
| NM_005080_138-156 | 21 | 2 | 2 | 1 | 1 | 1 | 1 | 1 |
| NM_005080_145-163 | 10 | 2 | 5 | 1 | 1 | 1 | 3 | 1 |
| NM_005080_190-208 | 4 | 2 | 3 | 2 | 1 | 1 | 2 | 1 |
| NM_005080_191-209 | 13 | 2 | 3 | 1 | 2 | 1 | 5 | 1 |
| NM_005080_192-210 | 5 | 2 | 1 | 1 | 1 | 1 | 1 | 1 |
| NM_005080_259-277 | 6 | 2 | 1 | 1 | 3 | 1 | 3 | 1 |
| NM_005080_261-279 | 19 | 2 | 1 | 1 | 2 | 1 | 1 | 0 |
| NM_005080_289-307 | 1 | 2 | 1 | 1 | 2 | 1 | 1 | 1 |
| NM_005080_363-381 | 15 | 2 | 5 | 2 | 2 | 1 | 6 | 2 |
| NM_005080_365-383 | 5 | 2 | 2 | 2 | 2 | 1 | 3 | 1.2 |
| NM_005080_385-403 | 4 | 2 | 3 | 2 | 1 | 1 | 9 | 2 |
| NM_005080_461-479 | 1 | 2 | 1 | 1.2 | 2 | 1 | 5 | 2.2 |
| NM_005080_490-508 | 3 | 2 | 1 | 3 | 1 | 1 | 3 | 3 |
| NM_005080_518-536 | 3 | 2 | 1 | 1 | 2 | 1 | 1 | 1 |
| NM_005080_673-691 | 6 | 2 | 3 | 2.2 | 2 | 1 | 2 | 2.2 |
| NM_005080_685-703 | 1 | 2 | 3 | 2 | 1 | 1 | 3 | 2 |
| NM_005080_730-748 | 3 | 2 | 4 | 2 | 1 | 1 | 1 | 2 |
| NM_005080_772-790 | 3 | 2 | 1 | 2 | 1 | 1 | 7 | 2 |
| NM_005080_801-819 | 5 | 2 | 1 | 1 | 1 | 1 | 2 | 1 |
| NM_005080_817-835 | 2 | 2 | 1 | 2 | 1 | 1 | 3 | 2 |
| NM_005080_887-905 | 3 | 2 | 1 | 2.2 | 1 | 1 | 2 | 2 |
| NM_005080_924-942 | 7 | 2 | 2 | 1 | 4 | 1 | 1 | 1 |
| NM_005080_927-945 | 13 | 2 | 3 | 2 | 4 | 1 | 6 | 2 |
| NM_005080_928-946 | 1 | 2 | 3 | 2 | 1 | 1 | 2 | 2.8 |
| NM_005080_974-992 | 4 | 2 | 1 | 1 | 2 | 1 | 1 | 2 |
| NM_005080_985-1003 | 13 | 2 | 2 | 2 | 1 | 1 | 3 | 3 |
| NM_005080_187-205 | 4 | 2 | 8 | 2 | 1 | 0 | 1 | 0 |
| NM_005080_672-690 | 8 | 2 | 2 | 2 | 1 | 0 | 1 | 2 |
| NM_005080_771-789 | 3 | 2 | 10 | 2 | 1 | 0 | 6 | 1 |
| NM_005080_1740-1758 | 1 | 1.2 | 5 | 2 | 1 | 3.2 | 1 | 2.2 |
| NM_005080_1741-1759 | 1 | 1.2 | 2 | 1 | 3 | 3.2 | 1 | 2.2 |
| NM_005080_662-680 | 1 | 1.2 | 2 | 1 | 1 | 2.4 | 2 | 1 |
| NM_005080_1070-1088 | 1 | 1.2 | 6 | 2 | 4 | 2.2 | 14 | 2 |
| NM_005080_631-649 | 1 | 1.2 | 2 | 0 | 2 | 2.2 | 1 | 1 |
| NM_005080_647-665 | 2 | 1.2 | 2 | 2 | 2 | 2.2 | 1 | 2 |
| NM_005080_791-809 | 1 | 1.2 | 2 | 2.2 | 1 | 2.2 | 1 | 2.2 |
| NM_005080_981-999 | 2 | 1.2 | 1 | 2 | 14 | 2.2 | 1 | 2 |
| NM_005080_1068-1086 | 1 | 1.2 | 1 | 2 | 1 | 2 | 1 | 2 |
| NM_005080_1391-1409 | 1 | 1.2 | 1 | 1 | 1 | 2 | 1 | 1 |
| NM_005080_1426-1444 | 2 | 1.2 | 2 | 2.4 | 1 | 2 | 9 | 3 |
| NM_005080_103-121 | 1 | 1.2 | 6 | 3 | 8 | 2 | 9 | 3 |
| NM_005080_1457-1475 | 1 | 1.2 | 2 | 2.2 | 2 | 2 | 1 | 2 |
| NM_005080_1568-1586 | 2 | 1.2 | 1 | 2 | 5 | 2 | 10 | 2 |
| NM_005080_1574-1592 | 1 | 1.2 | 13 | 3 | 7 | 2 | 2 | 2 |
| NM_005080_1577-1595 | 1 | 1.2 | 1 | 1 | 5 | 2 | 3 | 1 |
| NM_005080_1730-1748 | 2 | 1.2 | 1 | 1 | 4 | 2 | 3 | 1 |
| NM_005080_1731-1749 | 4 | 1.2 | 1 | 1.2 | 4 | 2 | 3 | 1.2 |
| NM_005080_1732-1750 | 2 | 1.2 | 3 | 2 | 3 | 2 | 5 | 2 |
| NM_005080_293-311 | 2 | 1.2 | 4 | 2 | 3 | 2 | 5 | 2 |
| NM_005080_350-368 | 1 | 1.2 | 3 | 2.2 | 1 | 2 | 1 | 1.2 |
| NM_005080_351-369 | 1 | 1.2 | 1 | 2.2 | 5 | 2 | 1 | 2.2 |
| NM_005080_630-648 | 1 | 1.2 | 2 | 2 | 1 | 2 | 2 | 2 |
| NM_005080_657-675 | 2 | 1.2 | 1 | 1 | 2 | 2 | 1 | 1 |
| NM_005080_670-688 | 1 | 1.2 | 4 | 2 | 2 | 2 | 2 | 3 |
| NM_005080_692-710 | 2 | 1.2 | 1 | 1 | 1 | 2 | 6 | 1 |
| NM_005080_778-796 | 1 | 1.2 | 8 | 3 | 4 | 2 | 2 | 2 |
| NM_005080_790-808 | 1 | 1.2 | 8 | 2.2 | 1 | 2 | 3 | 3 |
| NM_005080_970-988 | 1 | 1.2 | 2 | 2 | 6 | 2 | 2 | 2 |
| NM_005080_1162-1180 | 1 | 1.2 | 7 | 3 | 3 | 1.2 | 1 | 2.2 |
| NM_005080_1368-1386 | 1 | 1.2 | 3 | 2.8 | 1 | 1.2 | 5 | 3 |
| NM_005080_1515-1533 | 1 | 1.2 | 1 | 2 | 2 | 1.2 | 2 | 2.2 |

TABLE 10-continued

XBP-1 Human/Rhesus siRNA analysis

| | off target | | | | | | | |
|---|---|---|---|---|---|---|---|---|
| | human | | | | rhesus | | | |
| Oligo Name/ Location of Target sequence from 5' to 3' | Anti- sense Count | Anti- sense Score | Sense Count | Sense Score | Antisense Count | Antisense Score | Sense Count | Sense Score |
|---|---|---|---|---|---|---|---|---|
| NM_005080_1541-1559 | 1 | 1.2 | 4 | 2 | 1 | 1.2 | 1 | 2 |
| NM_005080_1542-1560 | 1 | 1.2 | 1 | 2 | 1 | 1.2 | 2 | 2 |
| NM_005080_1571-1589 | 1 | 1.2 | 2 | 2 | 1 | 1.2 | 4 | 2 |
| NM_005080_151-169 | 1 | 1.2 | 11 | 2 | 1 | 1.2 | 8 | 3 |
| NM_005080_160-178 | 2 | 1.2 | 3 | 2 | 1 | 1.2 | 5 | 2 |
| NM_005080_326-344 | 1 | 1.2 | 1 | 3.2 | 1 | 1.2 | 1 | 3 |
| NM_005080_327-345 | 1 | 1.2 | 2 | 3.2 | 1 | 1.2 | 1 | 3 |
| NM_005080_331-349 | 2 | 1.2 | 4 | 2 | 2 | 1.2 | 1 | 1 |
| NM_005080_424-442 | 1 | 1.2 | 1 | 2.2 | 1 | 1.2 | 2 | 2 |
| NM_005080_483-501 | 3 | 1.2 | 1 | 1.2 | 3 | 1.2 | 1 | 1.2 |
| NM_005080_579-597 | 2 | 1.2 | 1 | 2.2 | 2 | 1.2 | 1 | 2 |
| NM_005080_745-763 | 1 | 1.2 | 1 | 2 | 1 | 1.2 | 1 | 2.2 |
| NM_005080_746-764 | 1 | 1.2 | 2 | 2 | 1 | 1.2 | 1 | 2 |
| NM_005080_812-830 | 2 | 1.2 | 5 | 2 | 1 | 1.2 | 4 | 2 |
| NM_005080_871-889 | 1 | 1.2 | 2 | 3 | 7 | 1.2 | 3 | 3 |
| NM_005080_892-910 | 2 | 1.2 | 3 | 3 | 8 | 1.2 | 1 | 2 |
| NM_005080_978-996 | 1 | 1.2 | 2 | 2 | 1 | 1.2 | 1 | 1.2 |
| NM_005080_982-1000 | 1 | 1.2 | 4 | 2.8 | 8 | 1.2 | 4 | 2.8 |
| NM_005080_257-275 | 1 | 1.2 | 2 | 1 | 1 | 1 | 3 | 1 |
| NM_005080_364-382 | 2 | 1.2 | 7 | 2 | 2 | 1 | 3 | 1 |
| NM_005080_816-834 | 1 | 1.2 | 2 | 2 | 2 | 1 | 2 | 2 |
| NM_005080_884-902 | 1 | 1.2 | 6 | 2 | 1 | 1 | 1 | 2 |
| NM_005080_925-943 | 1 | 1.2 | 6 | 2.2 | 4 | 1 | 1 | 2 |
| NM_005080_1440-1458 | 1 | 1 | 2 | 2 | 1 | 2.8 | 5 | 2 |
| NM_005080_784-802 | 1 | 1 | 2 | 2 | 20 | 2.8 | 1 | 1 |
| NM_005080_1593-1611 | 2 | 1 | 1 | 2 | 2 | 2.2 | 1 | 2 |
| NM_005080_301-319 | 1 | 1 | 10 | 3 | 2 | 2.2 | 9 | 3 |
| NM_005080_674-692 | 2 | 1 | 2 | 2.4 | 1 | 2.2 | 1 | 1.2 |
| NM_005080_783-801 | 1 | 1 | 2 | 2 | 2 | 2.2 | 3 | 1 |
| NM_005080_921-939 | 1 | 1 | 4 | 2 | 10 | 2.2 | 2 | 2 |
| NM_005080_1226-1244 | 2 | 1 | 3 | 1 | 4 | 2 | 1 | 1 |
| NM_005080_1283-1301 | 2 | 1 | 1 | 2 | 5 | 2 | 2 | 1.2 |
| NM_005080_1416-1434 | 1 | 1 | 1 | 1 | 9 | 2 | 10 | 2 |
| NM_005080_1420-1438 | 1 | 1 | 1 | 1 | 5 | 2 | 1 | 1 |
| NM_005080_1488-1506 | 1 | 1 | 3 | 2 | 1 | 2 | 2 | 1 |
| NM_005080_1492-1510 | 1 | 1 | 1 | 2.2 | 1 | 2 | 3 | 3 |
| NM_005080_111-129 | 1 | 1 | 3 | 1 | 10 | 2 | 1 | 1 |
| NM_005080_1639-1657 | 1 | 1 | 4 | 2 | 1 | 2 | 2 | 2 |
| NM_005080_1685-1703 | 1 | 1 | 2 | 2 | 8 | 2 | 1 | 2 |
| NM_005080_1733-1751 | 2 | 1 | 1 | 1 | 7 | 2 | 1 | 1 |
| NM_005080_1734-1752 | 1 | 1 | 5 | 2 | 7 | 2 | 1 | 1 |
| NM_005080_1737-1755 | 1 | 1 | 2 | 1 | 2 | 2 | 2 | 1 |
| NM_005080_1756-1774 | 2 | 1 | 3 | 2 | 7 | 2 | 2 | 2 |
| NM_005080_1757-1775 | 1 | 1 | 4 | 2 | 7 | 2 | 3 | 2 |
| NM_005080_152-170 | 1 | 1 | 6 | 2 | 5 | 2 | 4 | 2 |
| NM_005080_153-171 | 1 | 1 | 3 | 2 | 1 | 2 | 4 | 2 |
| NM_005080_163-181 | 2 | 1 | 3 | 2 | 1 | 2 | 4 | 2 |
| NM_005080_167-185 | 1 | 1 | 2 | 0 | 2 | 2 | 1 | 1 |
| NM_005080_200-218 | 1 | 1 | 1 | 2 | 9 | 2 | 1 | 2 |
| NM_005080_252-270 | 9 | 1 | 5 | 2 | 6 | 2 | 7 | 2 |
| NM_005080_255-273 | 2 | 1 | 1 | 1.2 | 3 | 2 | 1 | 1.2 |
| NM_005080_260-278 | 1 | 1 | 1 | 1 | 34 | 2 | 1 | 0 |
| NM_005080_271-289 | 2 | 1 | 3 | 2 | 8 | 2 | 4 | 2 |
| NM_005080_297-315 | 1 | 1 | 1 | 1.2 | 9 | 2 | 1 | 1.2 |
| NM_005080_300-318 | 1 | 1 | 2 | 2 | 1 | 2 | 1 | 2 |
| NM_005080_335-353 | 2 | 1 | 2 | 1 | 4 | 2 | 1 | 1 |
| NM_005080_368-386 | 1 | 1 | 1 | 2 | 1 | 2 | 6 | 2 |
| NM_005080_378-396 | 5 | 1 | 2 | 1 | 6 | 2 | 1 | 1 |
| NM_005080_379-397 | 5 | 1 | 4 | 2 | 7 | 2 | 3 | 2 |
| NM_005080_380-398 | 4 | 1 | 4 | 2 | 5 | 2 | 1 | 1 |
| NM_005080_389-407 | 1 | 1 | 3 | 2 | 1 | 2 | 1 | 1 |
| NM_005080_426-444 | 1 | 1 | 1 | 2 | 4 | 2 | 1 | 1 |
| NM_005080_427-445 | 1 | 1 | 4 | 1.2 | 3 | 2 | 1 | 1 |
| NM_005080_485-503 | 2 | 1 | 1 | 1.2 | 12 | 2 | 1 | 1 |
| NM_005080_487-505 | 1 | 1 | 2 | 1 | 6 | 2 | 1 | 1 |
| NM_005080_488-506 | 2 | 1 | 2 | 2 | 1 | 2 | 3 | 2 |
| NM_005080_511-529 | 1 | 1 | 1 | 1.2 | 4 | 2 | 21 | 2 |
| NM_005080_526-544 | 3 | 1 | 1 | 2 | 1 | 2 | 5 | 2.2 |

TABLE 10-continued

XBP-1 Human/Rhesus siRNA analysis

| | off target | | | | | | | |
|---|---|---|---|---|---|---|---|---|
| | human | | | | rhesus | | | |
| Oligo Name/ Location of Target sequence from 5' to 3' | Antisense Count | Antisense Score | Sense Count | Sense Score | Antisense Count | Antisense Score | Sense Count | Sense Score |
| NM_005080_575-593 | 1 | 1 | 2 | 2 | 2 | 2 | 1 | 2 |
| NM_005080_593-611 | 2 | 1 | 3 | 2.2 | 16 | 2 | 1 | 2 |
| NM_005080_595-613 | 1 | 1 | 8 | 2 | 4 | 2 | 4 | 2 |
| NM_005080_654-672 | 2 | 1 | 3 | 2 | 3 | 2 | 2 | 2 |
| NM_005080_675-693 | 3 | 1 | 1 | 2 | 1 | 2 | 4 | 2.2 |
| NM_005080_683-701 | 1 | 1 | 1 | 2 | 3 | 2 | 1 | 1 |
| NM_005080_684-702 | 1 | 1 | 2 | 2 | 3 | 2 | 4 | 2 |
| NM_005080_693-711 | 2 | 1 | 8 | 1 | 3 | 2 | 1 | 1 |
| NM_005080_694-712 | 3 | 1 | 12 | 2 | 2 | 2 | 8 | 2 |
| NM_005080_726-744 | 2 | 1 | 1 | 1.2 | 14 | 2 | 1 | 1.2 |
| NM_005080_744-762 | 2 | 1 | 2 | 2 | 2 | 2 | 3 | 2 |
| NM_005080_765-783 | 1 | 1 | 2 | 3 | 2 | 2 | 1 | 2.8 |
| NM_005080_768-786 | 3 | 1 | 2 | 2 | 2 | 2 | 3 | 2 |
| NM_005080_777-795 | 1 | 1 | 4 | 2 | 2 | 2 | 5 | 2 |
| NM_005080_802-820 | 1 | 1 | 2 | 1 | 7 | 2 | 3 | 2 |
| NM_005080_877-895 | 1 | 1 | 2 | 2.2 | 5 | 2 | 2 | 1 |
| NM_005080_878-896 | 1 | 1 | 2 | 2.2 | 2 | 2 | 1 | 2 |
| NM_005080_885-903 | 1 | 1 | 3 | 2 | 2 | 2 | 2 | 2 |
| NM_005080_886-904 | 1 | 1 | 3 | 2 | 2 | 2 | 2 | 2 |
| NM_005080_966-984 | 1 | 1 | 2 | 2.2 | 2 | 2 | 1 | 2.4 |
| NM_005080_969-987 | 1 | 1 | 5 | 2 | 12 | 2 | 2 | 2 |
| NM_005080_1245-1263 | 1 | 1 | 1 | 2 | 1 | 1.2 | 2 | 2 |
| NM_005080_1738-1756 | 1 | 1 | 9 | 2 | 2 | 1.2 | 1 | 1 |
| NM_005080_194-212 | 1 | 1 | 1 | 1 | 1 | 1.2 | 2 | 1 |
| NM_005080_209-227 | 1 | 1 | 1 | 1 | 1 | 1.2 | 1 | 1 |
| NM_005080_269-287 | 2 | 1 | 21 | 2 | 3 | 1.2 | 17 | 2 |
| NM_005080_902-920 | 1 | 1 | 1 | 1.2 | 5 | 1.2 | 1 | 2.2 |
| NM_005080_50-68 | 2 | 1 | 8 | 1 | 1 | 1.2 | 8 | 1 |
| NM_005080_1017-1035 | 1 | 1 | 1 | 2.2 | 1 | 1 | 4 | 3 |
| NM_005080_1021-1039 | 2 | 1 | 1 | 2 | 1 | 1 | 1 | 2 |
| NM_005080_1022-1040 | 1 | 1 | 1 | 1 | 1 | 1 | 2 | 2 |
| NM_005080_1062-1080 | 2 | 1 | 3 | 2 | 3 | 1 | 1 | 2 |
| NM_005080_1074-1092 | 1 | 1 | 1 | 2 | 2 | 1 | 2 | 2.2 |
| NM_005080_1116-1134 | 5 | 1 | 2 | 2.2 | 2 | 1 | 12 | 3 |
| NM_005080_1149-1167 | 1 | 1 | 1 | 2 | 1 | 1 | 10 | 3 |
| NM_005080_1150-1168 | 2 | 1 | 1 | 2 | 8 | 1 | 1 | 1.2 |
| NM_005080_1161-1179 | 1 | 1 | 1 | 2 | 1 | 1 | 1 | 2 |
| NM_005080_1223-1241 | 2 | 1 | 2 | 1 | 5 | 1 | 25 | 2 |
| NM_005080_1280-1298 | 1 | 1 | 1 | 1 | 1 | 1 | 1 | 1 |
| NM_005080_1281-1299 | 1 | 1 | 1 | 1 | 1 | 1 | 3 | 1 |
| NM_005080_1284-1302 | 4 | 1 | 1 | 1 | 1 | 1 | 1 | 1 |
| NM_005080_1286-1304 | 1 | 1 | 3 | 2 | 2 | 1 | 2 | 2 |
| NM_005080_1288-1306 | 2 | 1 | 5 | 2 | 3 | 1 | 1 | 2 |
| NM_005080_1365-1383 | 1 | 1 | 1 | 2.2 | 1 | 1 | 10 | 3 |
| NM_005080_1417-1435 | 2 | 1 | 4 | 2 | 1 | 1 | 5 | 2 |
| NM_005080_1421-1439 | 1 | 1 | 2 | 2 | 1 | 1 | 1 | 2 |
| NM_005080_1434-1452 | 3 | 1 | 1 | 2 | 1 | 1 | 1 | 2.2 |
| NM_005080_1452-1470 | 1 | 1 | 4 | 2 | 1 | 1 | 4 | 2 |
| NM_005080_105-123 | 1 | 1 | 1 | 1 | 2 | 1 | 3 | 2 |
| NM_005080_1455-1473 | 1 | 1 | 5 | 2 | 2 | 1 | 3 | 2 |
| NM_005080_112-130 | 1 | 1 | 2 | 1 | 1 | 1 | 1 | 1.2 |
| NM_005080_113-131 | 2 | 1 | 3 | 1 | 2 | 1 | 1 | 1 |
| NM_005080_1543-1561 | 3 | 1 | 3 | 2.2 | 2 | 1 | 1 | 2.2 |
| NM_005080_1544-1562 | 2 | 1 | 6 | 3 | 2 | 1 | 1 | 2 |
| NM_005080_1557-1575 | 1 | 1 | 6 | 2 | 4 | 1 | 6 | 1 |
| NM_005080_115-133 | 2 | 1 | 1 | 0 | 1 | 1 | 1 | 1.2 |
| NM_005080_1564-1582 | 1 | 1 | 3 | 1 | 4 | 1 | 4 | 1 |
| NM_005080_1572-1590 | 1 | 1 | 3 | 2 | 1 | 1 | 4 | 2 |
| NM_005080_1575-1593 | 1 | 1 | 5 | 2 | 1 | 1 | 4 | 2 |
| NM_005080_1576-1594 | 1 | 1 | 1 | 2 | 1 | 1 | 1 | 2 |
| NM_005080_117-135 | 4 | 1 | 3 | 1 | 14 | 1 | 10 | 1 |
| NM_005080_1582-1600 | 1 | 1 | 9 | 2 | 1 | 1 | 1 | 1 |
| NM_005080_1587-1605 | 1 | 1 | 5 | 2 | 3 | 1 | 12 | 2 |
| NM_005080_118-136 | 8 | 1 | 5 | 1 | 10 | 1 | 3 | 1 |
| NM_005080_119-137 | 7 | 1 | 2 | 1 | 4 | 1 | 1 | 1 |
| NM_005080_120-138 | 6 | 1 | 47 | 2 | 7 | 1 | 35 | 2 |
| NM_005080_124-142 | 6 | 1 | 1 | 0 | 1 | 1 | 1 | 0 |
| NM_005080_126-144 | 1 | 1 | 3 | 1 | 2 | 1 | 1 | 1 |

TABLE 10-continued

XBP-1 Human/Rhesus siRNA analysis

| | off target | | | | | | | |
|---|---|---|---|---|---|---|---|---|
| | human | | | | rhesus | | | |
| Oligo Name/ Location of Target sequence from 5' to 3' | Anti-sense Count | Anti-sense Score | Sense Count | Sense Score | Antisense Count | Antisense Score | Sense Count | Sense Score |
| NM_005080_1676-1694 | 1 | 1 | 2 | 2 | 1 | 1 | 5 | 2 |
| NM_005080_127-145 | 7 | 1 | 2 | 1 | 3 | 1 | 1 | 1 |
| NM_005080_129-147 | 3 | 1 | 18 | 2 | 2 | 1 | 2 | 1 |
| NM_005080_130-148 | 4 | 1 | 7 | 1 | 1 | 1 | 5 | 1 |
| NM_005080_131-149 | 1 | 1 | 1 | 0 | 1 | 1 | 6 | 1 |
| NM_005080_1720-1738 | 1 | 1 | 1 | 3 | 4 | 1 | 1 | 3 |
| NM_005080_1724-1742 | 1 | 1 | 2 | 2 | 2 | 1 | 2 | 2 |
| NM_005080_132-150 | 3 | 1 | 3 | 1 | 1 | 1 | 3 | 1 |
| NM_005080_133-151 | 5 | 1 | 1 | 1 | 3 | 1 | 3 | 1 |
| NM_005080_134-152 | 2 | 1 | 1 | 1.2 | 1 | 1 | 1 | 1 |
| NM_005080_136-154 | 3 | 1 | 1 | 1 | 2 | 1 | 7 | 1 |
| NM_005080_1777-1795 | 1 | 1 | 1 | 1 | 1 | 1 | 4 | 2 |
| NM_005080_137-155 | 4 | 1 | 4 | 1 | 4 | 1 | 7 | 1 |
| NM_005080_139-157 | 10 | 1 | 1 | 1.2 | 2 | 1 | 7 | 2 |
| NM_005080_140-158 | 1 | 1 | 1 | 1.2 | 2 | 1 | 1 | 1.2 |
| NM_005080_141-159 | 7 | 1 | 1 | 0 | 7 | 1 | 1 | 0 |
| NM_005080_142-160 | 4 | 1 | 1 | 0 | 1 | 1 | 1 | 0 |
| NM_005080_143-161 | 6 | 1 | 1 | 0 | 2 | 1 | 3 | 1 |
| NM_005080_144-162 | 1 | 1 | 5 | 1 | 4 | 1 | 9 | 1 |
| NM_005080_161-179 | 2 | 1 | 4 | 2 | 1 | 1 | 1 | 2 |
| NM_005080_162-180 | 4 | 1 | 6 | 2 | 2 | 1 | 6 | 3 |
| NM_005080_164-182 | 2 | 1 | 2 | 2 | 1 | 1 | 4 | 2 |
| NM_005080_165-183 | 1 | 1 | 7 | 2 | 4 | 1 | 1 | 1 |
| NM_005080_166-184 | 3 | 1 | 2 | 1 | 2 | 1 | 7 | 1 |
| NM_005080_201-219 | 4 | 1 | 4 | 2 | 1 | 1 | 1 | 2 |
| NM_005080_202-220 | 5 | 1 | 3 | 1 | 4 | 1 | 1 | 1 |
| NM_005080_203-221 | 3 | 1 | 6 | 1 | 3 | 1 | 1 | 1 |
| NM_005080_204-222 | 3 | 1 | 9 | 1 | 2 | 1 | 1 | 1 |
| NM_005080_208-226 | 3 | 1 | 2 | 1 | 2 | 1 | 4 | 1 |
| NM_005080_212-230 | 2 | 1 | 2 | 1 | 1 | 1 | 5 | 2 |
| NM_005080_248-266 | 4 | 1 | 1 | 1 | 5 | 1 | 11 | 1 |
| NM_005080_251-269 | 1 | 1 | 9 | 2 | 2 | 1 | 1 | 1 |
| NM_005080_258-276 | 2 | 1 | 2 | 2 | 1 | 1 | 12 | 2 |
| NM_005080_262-280 | 2 | 1 | 4 | 2 | 1 | 1 | 1 | 0 |
| NM_005080_265-283 | 2 | 1 | 2 | 2 | 3 | 1 | 4 | 2.2 |
| NM_005080_266-284 | 2 | 1 | 7 | 2 | 2 | 1 | 1 | 1 |
| NM_005080_267-285 | 4 | 1 | 2 | 1 | 1 | 1 | 1 | 1 |
| NM_005080_268-286 | 3 | 1 | 6 | 2 | 1 | 1 | 1 | 1 |
| NM_005080_270-288 | 3 | 1 | 4 | 2 | 1 | 1 | 6 | 2 |
| NM_005080_272-290 | 2 | 1 | 1 | 2 | 1 | 1 | 2 | 2 |
| NM_005080_273-291 | 2 | 1 | 4 | 1 | 3 | 1 | 1 | 2 |
| NM_005080_277-295 | 4 | 1 | 3 | 1 | 2 | 1 | 1 | 1 |
| NM_005080_328-346 | 1 | 1 | 2 | 2 | 1 | 1 | 8 | 3 |
| NM_005080_329-347 | 1 | 1 | 1 | 2 | 1 | 1 | 11 | 3 |
| NM_005080_334-352 | 1 | 1 | 4 | 1 | 1 | 1 | 2 | 1 |
| NM_005080_336-354 | 1 | 1 | 1 | 1 | 1 | 1 | 1 | 1 |
| NM_005080_337-355 | 4 | 1 | 1 | 1 | 2 | 1 | 1 | 1 |
| NM_005080_338-356 | 5 | 1 | 1 | 1 | 3 | 1 | 1 | 1.2 |
| NM_005080_356-374 | 1 | 1 | 1 | 1 | 1 | 1 | 1 | 2 |
| NM_005080_357-375 | 2 | 1 | 2 | 2 | 2 | 1 | 2 | 2 |
| NM_005080_359-377 | 1 | 1 | 1 | 2 | 1 | 1 | 2 | 2.8 |
| NM_005080_360-378 | 1 | 1 | 1 | 2 | 1 | 1 | 1 | 2 |
| NM_005080_362-380 | 4 | 1 | 1 | 1 | 4 | 1 | 1 | 1 |
| NM_005080_367-385 | 1 | 1 | 3 | 2 | 1 | 1 | 2 | 2 |
| NM_005080_382-400 | 6 | 1 | 8 | 2.2 | 2 | 1 | 5 | 1.2 |
| NM_005080_386-404 | 1 | 1 | 2 | 2 | 1 | 1 | 2 | 2 |
| NM_005080_401-419 | 2 | 1 | 3 | 1 | 1 | 1 | 1 | 1 |
| NM_005080_458-476 | 3 | 1 | 1 | 2 | 1 | 1 | 3 | 2 |
| NM_005080_484-502 | 3 | 1 | 6 | 2 | 2 | 1 | 1 | 1 |
| NM_005080_489-507 | 2 | 1 | 1 | 2 | 1 | 1 | 1 | 1.2 |
| NM_005080_574-592 | 1 | 1 | 3 | 2 | 5 | 1 | 4 | 2.2 |
| NM_005080_594-612 | 6 | 1 | 7 | 2 | 13 | 1 | 12 | 2 |
| NM_005080_604-622 | 4 | 1 | 2 | 2 | 3 | 1 | 3 | 2 |
| NM_005080_627-645 | 2 | 1 | 2 | 1 | 3 | 1 | 3 | 1 |
| NM_005080_635-653 | 1 | 1 | 4 | 2 | 3 | 1 | 2 | 2 |
| NM_005080_636-654 | 1 | 1 | 8 | 1.2 | 2 | 1 | 1 | 1.2 |
| NM_005080_666-684 | 2 | 1 | 4 | 2.2 | 7 | 1 | 9 | 3 |
| NM_005080_667-685 | 1 | 1 | 1 | 2 | 1 | 1 | 1 | 2 |

TABLE 10-continued

XBP-1 Human/Rhesus siRNA analysis

| | off target | | | | | | | |
|---|---|---|---|---|---|---|---|---|
| Oligo Name/ | human | | | | rhesus | | | |
| Location of Target | Anti- | Anti- | | | | | | |
| sequence from 5' to 3' | sense Count | sense Score | Sense Count | Sense Score | Antisense Count | Antisense Score | Sense Count | Sense Score |
| NM_005080_669-687 | 1 | 1 | 8 | 3 | 1 | 1 | 4 | 3 |
| NM_005080_681-699 | 2 | 1 | 4 | 2 | 1 | 1 | 2 | 2 |
| NM_005080_690-708 | 5 | 1 | 5 | 2 | 1 | 1 | 6 | 2 |
| NM_005080_718-736 | 4 | 1 | 1 | 1.2 | 5 | 1 | 1 | 1 |
| NM_005080_722-740 | 3 | 1 | 1 | 1 | 3 | 1 | 2 | 1 |
| NM_005080_723-741 | 3 | 1 | 1 | 1 | 3 | 1 | 1 | 1 |
| NM_005080_724-742 | 6 | 1 | 2 | 1 | 4 | 1 | 3 | 0 |
| NM_005080_725-743 | 5 | 1 | 2 | 1 | 2 | 1 | 7 | 1 |
| NM_005080_727-745 | 1 | 1 | 1 | 1 | 1 | 1 | 2 | 1.2 |
| NM_005080_728-746 | 1 | 1 | 2 | 1 | 3 | 1 | 4 | 1 |
| NM_005080_739-757 | 1 | 1 | 5 | 2.2 | 4 | 1 | 1 | 2.2 |
| NM_005080_747-765 | 1 | 1 | 1 | 2 | 7 | 1 | 8 | 3 |
| NM_005080_763-781 | 1 | 1 | 2 | 2 | 6 | 1 | 1 | 2 |
| NM_005080_764-782 | 3 | 1 | 1 | 2.8 | 3 | 1 | 1 | 2.2 |
| NM_005080_766-784 | 1 | 1 | 13 | 2 | 1 | 1 | 1 | 1 |
| NM_005080_770-788 | 1 | 1 | 2 | 1 | 1 | 1 | 4 | 2 |
| NM_005080_774-792 | 2 | 1 | 2 | 1 | 4 | 1 | 1 | 1 |
| NM_005080_780-798 | 5 | 1 | 1 | 1 | 20 | 1 | 1 | 1 |
| NM_005080_781-799 | 5 | 1 | 4 | 2 | 20 | 1 | 8 | 2 |
| NM_005080_805-823 | 1 | 1 | 1 | 1 | 1 | 1 | 3 | 1 |
| NM_005080_44-62 | 30 | 1 | 4 | 2 | 42 | 1 | 5 | 2.8 |
| NM_005080_45-63 | 2 | 1 | 3 | 0 | 5 | 1 | 5 | 0 |
| NM_005080_868-886 | 1 | 1 | 1 | 2.2 | 1 | 1 | 16 | 3 |
| NM_005080_875-893 | 1 | 1 | 1 | 3.2 | 1 | 1 | 3 | 3.2 |
| NM_005080_47-65 | 5 | 1 | 6 | 2 | 10 | 1 | 1 | 1 |
| NM_005080_879-897 | 1 | 1 | 3 | 2 | 2 | 1 | 1 | 1 |
| NM_005080_880-898 | 1 | 1 | 3 | 2 | 1 | 1 | 3 | 2 |
| NM_005080_881-899 | 1 | 1 | 15 | 2 | 1 | 1 | 18 | 2 |
| NM_005080_882-900 | 1 | 1 | 2 | 2 | 1 | 1 | 1 | 2 |
| NM_005080_883-901 | 1 | 1 | 1 | 2 | 4 | 1 | 1 | 2 |
| NM_005080_49-67 | 3 | 1 | 1 | 0 | 1 | 1 | 13 | 1 |
| NM_005080_914-932 | 1 | 1 | 1 | 3 | 1 | 1 | 2 | 4 |
| NM_005080_915-933 | 1 | 1 | 1 | 2 | 1 | 1 | 4 | 3 |
| NM_005080_926-944 | 10 | 1 | 1 | 2 | 7 | 1 | 1 | 2 |
| NM_005080_945-963 | 2 | 1 | 3 | 2 | 3 | 1 | 7 | 2 |
| NM_005080_958-976 | 2 | 1 | 1 | 0 | 1 | 1 | 1 | 1 |
| NM_005080_959-977 | 2 | 1 | 1 | 0 | 1 | 1 | 1 | 2 |
| NM_005080_962-980 | 1 | 1 | 1 | 1 | 1 | 1 | 1 | 1 |
| NM_005080_975-993 | 1 | 1 | 4 | 2 | 1 | 1 | 2 | 2 |
| NM_005080_983-1001 | 1 | 1 | 3 | 1 | 1 | 1 | 1 | 1 |
| NM_005080_128-146 | 2 | 1 | 2 | 1 | 1 | 0 | 8 | 2 |
| NM_005080_249-267 | 1 | 1 | 1 | 1 | 1 | 0 | 11 | 1 |
| NM_005080_697-715 | 1 | 1 | 2 | 2 | 1 | 0 | 1 | 2.2 |
| NM_005080_729-747 | 3 | 1 | 2 | 1 | 1 | 0 | 9 | 1.2 |
| NM_005080_776-794 | 1 | 0 | 4 | 1.2 | 1 | 2.2 | 2 | 1.2 |
| NM_005080_803-821 | 1 | 0 | 11 | 2 | 2 | 2.2 | 4 | 2 |
| NM_005080_254-272 | 9 | 0 | 6 | 2 | 1 | 2 | 2 | 2 |
| NM_005080_383-401 | 2 | 0 | 2 | 2 | 2 | 2 | 7 | 2 |
| NM_005080_116-134 | 2 | 0 | 7 | 1 | 14 | 1 | 6 | 1 |
| NM_005080_123-141 | 1 | 0 | 1 | 1 | 2 | 1 | 13 | 2 |
| NM_005080_125-143 | 1 | 0 | 1 | 0 | 2 | 1 | 1 | 0 |
| NM_005080_135-153 | 2 | 0 | 10 | 2 | 1 | 1 | 1 | 0 |
| NM_005080_253-271 | 9 | 0 | 13 | 2 | 2 | 1 | 11 | 2 |
| NM_005080_274-292 | 1 | 0 | 3 | 1 | 2 | 1 | 2 | 2 |
| NM_005080_655-673 | 2 | 0 | 3 | 2.8 | 1 | 1 | 1 | 2 |
| NM_005080_775-793 | 1 | 0 | 2 | 1.2 | 1 | 1 | 1 | 1 |
| NM_005080_46-64 | 1 | 0 | 3 | 1 | 15 | 1 | 9 | 1 |
| NM_005080_1456-1474 | 1 | 0 | 4 | 2 | 2 | 0 | 1 | 1.2 |
| NM_005080_1545-1563 | 1 | 0 | 9 | 3 | 1 | 0 | 1 | 1 |
| NM_005080_1558-1576 | 1 | 0 | 2 | 2 | 3 | 0 | 8 | 2 |
| NM_005080_121-139 | 1 | 0 | 1 | 0 | 1 | 0 | 48 | 2 |
| NM_005080_122-140 | 1 | 0 | 1 | 1 | 1 | 0 | 13 | 2 |
| NM_005080_247-265 | 1 | 0 | 1 | 1 | 1 | 0 | 1 | 1 |
| NM_005080_275-293 | 1 | 0 | 4 | 1 | 1 | 0 | 2 | 1 |
| NM_005080_276-294 | 1 | 0 | 1 | 1 | 1 | 0 | 1 | 1 |
| NM_005080_358-376 | 1 | 0 | 8 | 2.2 | 1 | 0 | 6 | 2.2 |
| NM_005080_387-405 | 1 | 0 | 2 | 2 | 1 | 0 | 3 | 2 |
| NM_005080_628-646 | 2 | 0 | 1 | 0 | 2 | 0 | 3 | 1 |

TABLE 10-continued

XBP-1 Human/Rhesus siRNA analysis

| Oligo Name/ Location of Target sequence from 5' to 3' | human | | | | off target | | | |
|---|---|---|---|---|---|---|---|---|
| | | | | | rhesus | | | |
| | Anti-sense Count | Anti-sense Score | Sense Count | Sense Score | Antisense Count | Antisense Score | Sense Count | Sense Score |
| NM_005080_656-674 | 2 | 0 | 1 | 1 | 1 | 0 | 1 | 1 |
| NM_005080_719-737 | 1 | 0 | 6 | 2 | 1 | 0 | 6 | 2 |
| NM_005080_720-738 | 2 | 0 | 4 | 1 | 3 | 0 | 1 | 1 |
| NM_005080_721-739 | 1 | 0 | 1 | 1.2 | 1 | 0 | 9 | 2 |
| NM_005080_782-800 | 5 | 0 | 3 | 2 | 20 | 0 | 12 | 2 |
| NM_005080_867-885 | 2 | 0 | 5 | 2 | 2 | 0 | 1 | 2.2 |
| NM_005080_48-66 | 2 | 0 | 3 | 1 | 1 | 0 | 1 | 0 |
| NM_005080_963-981 | 1 | 0 | 1 | 1 | 1 | 0 | 5 | 2 |

Gene XBP-1
reference transcript NM_005080 (human XBP-1 mRNA, FIG. 2)
Notes
19mers found in both human and rhesus

TABLE 11

XBP-1 mouse/Rhesus siRNAs

| Target sequence on rhesus mRNA transcript 5' to 3' | sense (5'-3') | SEQ ID NO: | antinsense (5'-3') | SEQ ID NO: |
|---|---|---|---|---|
| NM_013842_369-387 | AGAAAACUCACGGCCUUGU | 2119 | ACAAGGCCGUGAGUUUUCU | 2120 |
| NM_013842_237-255 | AACUGAAAAACAGAGUAGC | 321 | GCUACUCUGUUUUUCAGUU | 322 |
| NM_013842_491-509 | GGGUCUGCUGAGUCCGCAG | 1693 | CUGCGGACUCAGCAGACCC | 1694 |
| NM_013842_917-935 | AUCACCCUGAAUUCAUUGU | 197 | ACAAUGAAUUCAGGGUGAU | 198 |
| NM_013842_923-941 | CUGAAUUCAUUGUCUCAGU | 2037 | ACUGAGACAAUGAAUUCAG | 2038 |
| NM_013842_702-720 | CCCAGAGGUCUACCCAGAA | 1181 | UUCUGGGUAGACCUCUGGG | 1182 |
| NM_013842_926-944 | AAUUCAUUGUCUCAGUGAA | 1349 | UUCACUGAGACAAUGAAUU | 1350 |
| NM_013842_391-409 | UGAGAACCAGGAGUUAAGA | 1035 | UCUUAACUCCUGGUUCUCA | 1036 |
| NM_013842_775-793 | AAGCUGGAAGCCAUUAAUG | 1249 | CAUUAAUGGCUUCCAGCUU | 1250 |
| NM_013842_1150-1168 | CCCCAGCUGAUUAGUGUCU | 123 | AGACACUAAUCAGCUGGGG | 124 |
| NM_013842_776-794 | AGCUGGAAGCCAUUAAUGA | 1251 | UCAUUAAUGGCUUCCAGCU | 1252 |
| NM_013842_921-939 | CCCUGAAUUCAUUGUCUCA | 1343 | UGAGACAAUGAAUUCAGGG | 1344 |
| NM_013842_777-795 | GCUGGAAGCCAUUAAUGAA | 1585 | UUCAUUAAUGGCUUCCAGC | 1586 |
| NM_013842_539-557 | GUGCAGGCCCAGUUGUCAC | 1951 | GUGACAACUGGGCCUGCAC | 1952 |
| NM_013842_731-749 | CCUUACCAGCCUCCCUUUC | 1995 | GAAAGGGAGGCUGGUAAGG | 1996 |
| NM_013842_924-942 | UGAAUUCAUUGUCUCAGUG | 2039 | CACUGAGACAAUGAAUUCA | 2040 |
| NM_013842_1151-1169 | CCCAGCUGAUUAGUGUCUA | 43 | UAGACACUAAUCAGCUGGG | 44 |
| NM_013842_1152-1170 | CCAGCUGAUUAGUGUCUAA | 125 | UUAGACACUAAUCAGCUGG | 126 |
| NM_013842_1718-1736 | ACUAUGUAAAUGCUUGAUG | 479 | CAUCAAGCAUUUACAUAGU | 480 |
| NM_013842_368-386 | GAGAAAACUCACGGCCUUG | 2121 | CAAGGCCGUGAGUUUUCUC | 2122 |
| NM_013842_489-507 | CCGGGUCUGCUGAGUCCGC | 499 | GCGGACUCAGCAGACCCGG | 500 |
| NM_013842_238-256 | ACUGAAAAACAGAGUAGCA | 289 | UGCUACUCUGUUUUUCAGU | 290 |

TABLE 11-continued

XBP-1 mouse/Rhesus siRNAs

| Target sequence on rhesus mRNA transcript 5' to 3' | sense (5'-3') | SEQ ID NO: | antisense (5'-3') | SEQ ID NO: |
|---|---|---|---|---|
| NM_013842_240-258 | UGAAAAACAGAGUAGCAGC | 529 | GCUGCUACUCUGUUUUUCA | 530 |
| NM_013842_390-408 | UUGAGAACCAGGAGUUAAG | 329 | CUUAACUCCUGGUUCUCAA | 330 |
| NM_013842_487-505 | GGCCGGGUCUGCUGAGUCC | 569 | GGACUCAGCAGACCCGGCC | 570 |
| NM_013842_741-759 | CUCCCUUUCUCUGUCAGUG | 2055 | CACUGACAGAGAAAGGGAG | 2056 |
| NM_013842_918-936 | UCACCCUGAAUUCAUUGUC | 157 | GACAAUGAAUUCAGGGUGA | 158 |
| NM_013842_919-937 | CACCCUGAAUUCAUUGUCU | 343 | AGACAAUGAAUUCAGGGUG | 344 |
| NM_013842_1130-1148 | CUUUUGCCAAUGAACUUUU | 2123 | AAAAGUUCAUUGGCAAAAG | 2124 |
| NM_013842_1712-1730 | AAAUUUACUAUGUAAAUGC | 845 | GCAUUUACAUAGUAAAUUU | 846 |
| NM_013842_1714-1732 | AUUUACUAUGUAAAUGCUU | 847 | AAGCAUUUACAUAGUAAAU | 848 |
| NM_013842_1717-1735 | UACUAUGUAAAUGCUUGAU | 851 | AUCAAGCAUUUACAUAGUA | 852 |
| NM_013842_1719-1737 | CUAUGUAAAUGCUUGAUGG | 853 | CCAUCAAGCAUUUACAUAG | 854 |
| NM_013842_1775-1793 | CCAUUUAUUUAAAACUACC | 379 | GGUAGUUUUAAAUAAAUGG | 380 |
| NM_013842_1776-1794 | CAUUUAUUUAAAACUACCC | 381 | GGGUAGUUUUAAAUAAAUG | 382 |
| NM_013842_239-257 | CUGAAAAACAGAGUAGCAG | 383 | CUGCUACUCUGUUUUUCAG | 384 |
| NM_013842_347-365 | CUAGAAAAUCAGCUUUUAC | 1013 | GUAAAAGCUGAUUUUCUAG | 1014 |
| NM_013842_348-366 | UAGAAAAUCAGCUUUUACG | 1679 | CGUAAAAGCUGAUUUUCUA | 1680 |
| NM_013842_485-503 | GUGGCCGGGUCUGCUGAGU | 1063 | ACUCAGCAGACCCGGCCAC | 1064 |
| NM_013842_486-504 | UGGCCGGGUCUGCUGAGUC | 1065 | GACUCAGCAGACCCGGCCA | 1066 |
| NM_013842_488-506 | GCCGGGUCUGCUGAGUCCG | 1067 | CGGACUCAGCAGACCCGGC | 1068 |
| NM_013842_540-558 | UGCAGGCCCAGUUGUCACC | 1695 | GGUGACAACUGGGCCUGCA | 1696 |
| NM_013842_703-721 | CCAGAGGUCUACCCAGAAG | 1183 | CUUCUGGGUAGACCUCUGG | 1184 |
| NM_013842_705-723 | AGAGGUCUACCCAGAAGGA | 1185 | UCCUUCUGGGUAGACCUCU | 1186 |
| NM_013842_730-748 | UCCUUACCAGCCUCCCUUU | 1717 | AAAGGGAGGCUGGUAAGGA | 1718 |
| NM_013842_742-760 | UCCCUUUCUCUGUCAGUGG | 1721 | CCACUGACAGAGAAAGGGA | 1722 |
| NM_013842_744-762 | CCUUUCUCUGUCAGUGGGG | 1221 | CCCCACUGACAGAGAAAGG | 1222 |
| NM_013842_767-785 | CAUCAGCCAAGCUGGAAGC | 1723 | GCUUCCAGCUUGGCUGAUG | 1724 |
| NM_013842_771-789 | AGCCAAGCUGGAAGCCAUU | 1241 | AAUGGCUUCCAGCUUGGCU | 1242 |
| NM_013842_916-934 | GAUCACCCUGAAUUCAUUG | 195 | CAAUGAAUUCAGGGUGAUC | 196 |
| NM_013842_920-938 | ACCCUGAAUUCAUUGUCUC | 1341 | GAGACAAUGAAUUCAGGGU | 1342 |
| NM_013842_922-940 | CCUGAAUUCAUUGUCUCAG | 1345 | CUGAGACAAUGAAUUCAGG | 1346 |
| NM_013842_925-943 | GAAUUCAUUGUCUCAGUGA | 1347 | UCACUGAGACAAUGAAUUC | 1348 |
| NM_013842_1720-1738 | UAUGUAAAUGCUUGAUGGA | 1841 | UCCAUCAAGCAUUUACAUA | 1842 |
| NM_013842_232-250 | GAGGAAACUGAAAAACAGA | 1911 | UCUGUUUUUCAGUUUCCUC | 1912 |
| NM_013842_236-254 | AAACUGAAAAACAGAGUAG | 1913 | CUACUCUGUUUUUCAGUUU | 1914 |
| NM_013842_728-746 | GUUCCUUACCAGCCUCCCU | 1991 | AGGGAGGCUGGUAAGGAAC | 1992 |
| NM_013842_729-747 | UUCCUUACCAGCCUCCCUU | 1993 | AAGGGAGGCUGGUAAGGAA | 1994 |

TABLE 11-continued

XBP-1 mouse/Rhesus siRNAs

| Target sequence on rhesus mRNA transcript 5' to 3' | sense (5'-3') | SEQ ID NO: | antinsense (5'-3') | SEQ ID NO: |
|---|---|---|---|---|
| NM_013842_745-763 | CUUUCUCUGUCAGUGGGGA | 2001 | UCCCCACUGACAGAGAAAG | 2002 |
| NM_013842_766-784 | UCAUCAGCCAAGCUGGAAG | 1473 | CUUCCAGCUUGGCUGAUGA | 1474 |
| NM_013842_927-945 | AUUCAUUGUCUCAGUGAAG | 2041 | CUUCACUGAGACAAUGAAU | 2042 |
| NM_013842_234-252 | GGAAACUGAAAAACAGAGU | 2093 | ACUCUGUUUUUCAGUUUCC | 2094 |
| NM_013842_235-253 | GAAACUGAAAAACAGAGUA | 2095 | UACUCUGUUUUUCAGUUUC | 2096 |
| NM_013842_346-364 | GCUAGAAAAUCAGCUUUUA | 2099 | UAAAAGCUGAUUUUCUAGC | 2100 |
| NM_013842_490-508 | CGGGUCUGCUGAGUCCGCA | 501 | UGCGGACUCAGCAGACCCG | 502 |
| NM_013842_700-718 | CUCCCAGAGGUCUACCCAG | 91 | CUGGGUAGACCUCUGGGAG | 92 |
| NM_013842_1715-1733 | UUUACUAUGUAAAUGCUUG | 849 | CAAGCAUUUACAUAGUAAA | 850 |
| NM_013842_734-752 | UACCAGCCUCCCUUUCUCU | 1217 | AGAGAAAGGGAGGCUGGUA | 1218 |
| NM_013842_773-791 | CCAAGCUGGAAGCCAUUAA | 1245 | UUAAUGGCUUCCAGCUUGG | 1246 |
| NM_013842_778-796 | CUGGAAGCCAUUAAUGAAC | 1253 | GUUCAUUAAUGGCUUCCAG | 1254 |
| NM_013842_779-797 | UGGAAGCCAUUAAUGAACU | 1255 | AGUUCAUUAAUGGCUUCCA | 1256 |
| NM_013842_1774-1792 | UCCAUUUAUUUAAAACUAC | 1853 | GUAGUUUUAAAUAAAUGGA | 1854 |
| NM_013842_704-722 | CAGAGGUCUACCCAGAAGG | 1987 | CCUUCUGGGUAGACCUCUG | 1988 |
| NM_013842_1716-1734 | UUACUAUGUAAAUGCUUGA | 477 | UCAAGCAUUUACAUAGUAA | 478 |
| NM_013842_1713-1731 | AAUUUACUAUGUAAAUGCU | 315 | AGCAUUUACAUAGUAAAUU | 316 |
| NM_013842_768-786 | AUCAGCCAAGCUGGAAGCC | 2057 | GGCUUCCAGCUUGGCUGAU | 2058 |
| NM_013842_1129-1147 | ACUUUUGCCAAUGAACUUU | 2125 | AAAGUUCAUUGGCAAAAGU | 2126 |
| NM_013842_389-407 | GUUGAGAACCAGGAGUUAA | 245 | UUAACUCCUGGUUCUCAAC | 246 |
| NM_013842_701-719 | UCCCAGAGGUCUACCCAGA | 1179 | UCUGGGUAGACCUCUGGGA | 1180 |
| NM_013842_706-724 | GAGGUCUACCCAGAAGGAC | 1187 | GUCCUUCUGGGUAGACCUC | 1188 |
| NM_013842_707-725 | AGGUCUACCCAGAAGGACC | 1189 | GGUCCUUCUGGGUAGACCU | 1190 |
| NM_013842_727-745 | AGUUCCUUACCAGCCUCCC | 1213 | GGGAGGCUGGUAAGGAACU | 1214 |
| NM_013842_733-751 | UUACCAGCCUCCCUUUCUC | 1719 | GAGAAAGGGAGGCUGGUAA | 1720 |
| NM_013842_736-754 | CCAGCCUCCCUUUCUCUGU | 1493 | ACAGAGAAAGGGAGGCUGG | 1494 |
| NM_013842_738-756 | AGCCUCCCUUUCUCUGUCA | 1219 | UGACAGAGAAAGGGAGGCU | 1220 |
| NM_013842_743-761 | CCCUUUCUCUGUCAGUGGG | 1547 | CCCACUGACAGAGAAAGGG | 1548 |
| NM_013842_769-787 | UCAGCCAAGCUGGAAGCCA | 1239 | UGGCUUCCAGCUUGGCUGA | 1240 |
| NM_013842_772-790 | GCCAAGCUGGAAGCCAUUA | 1243 | UAAUGGCUUCCAGCUUGGC | 1244 |
| NM_013842_774-792 | CAAGCUGGAAGCCAUUAAU | 1247 | AUUAAUGGCUUCCAGCUUG | 1248 |
| NM_013842_231-249 | GGAGGAAACUGAAAAACAG | 1909 | CUGUUUUUCAGUUUCCUCC | 1910 |
| NM_013842_233-251 | AGGAAACUGAAAAACAGAG | 2073 | CUCUGUUUUUCAGUUUCCU | 2074 |
| NM_013842_735-753 | ACCAGCCUCCCUUUCUCUG | 1997 | CAGAGAAAGGGAGGCUGGU | 1998 |
| NM_013842_737-755 | CAGCCUCCCUUUCUCUGUC | 1471 | GACAGAGAAAGGGAGGCUG | 1472 |
| NM_013842_739-757 | GCCUCCCUUUCUCUGUCAG | 1999 | CUGACAGAGAAAGGGAGGC | 2000 |

TABLE 11-continued

XBP-1 mouse/Rhesus siRNAs

| Target sequence on rhesus mRNA transcript 5'to 3' | sense (5'-3') | SEQ ID NO: | antisense (5'-3') | SEQ ID NO: |
|---|---|---|---|---|
| NM_013842_740-758 | CCUCCCUUUCUCUGUCAGU | 2077 | ACUGACAGAGAAAGGGAGG | 2078 |
| NM_013842_746-764 | UUUCUCUGUCAGUGGGGAC | 2003 | GUCCCCACUGACAGAGAAA | 2004 |
| NM_013842_770-788 | CAGCCAAGCUGGAAGCCAU | 2005 | AUGGCUUCCAGCUUGGCUG | 2006 |
| NM_013842_26-44 | GCUAUGGUGGUGGUGGCAG | 2079 | CUGCCACCACCACCAUAGC | 2080 |
| NM_013842_27-45 | CUAUGGUGGUGGUGGCAGC | 2015 | GCUGCCACCACCACCAUAG | 2016 |
| NM_013842_732-750 | CUUACCAGCCUCCCUUUCU | 1215 | AGAAAGGGAGGCUGGUAAG | 1216 |

Gene XBP-1
reference transcript NM_013842 (*Mus musculus* XPB 1 mRNA, FIG. 3)
Notes
100 siRNA sequences common to both mouse and rhesus

TABLE 12

XBP-1 mouse/Rhesus siRNAs with 3'dinucleotide overhangs

| Target sequence on rhesus mRNA transcript 5' to 3' | sense (5'-3') with 3' dinucleotide overhand | SEQ ID NO: | antisense (5'-3') with 3' dinucleotide overhang | SEQ ID NO: |
|---|---|---|---|---|
| NM_013842_369-387 | AGAAAACUCACGGCCUUGNN | 4321 | ACAAGGCCGUGAGUUUUCUNN | 4322 |
| NM_013842_237-255 | AACUGAAAACAGAGUAGCNN | 2523 | GCUACUCUGUUUUUCAGUUNN | 2524 |
| NM_013842_491-509 | GGGUCUGCUGAGUCCGCAGNN | 3895 | CUGCGGACUCAGCAGACCCNN | 3896 |
| NM_013842_917-935 | AUCACCCUGAAUUCAUUGUNN | 2399 | ACAAUGAAUUCAGGGUGAUNN | 2400 |
| NM_013842_923-941 | CUGAAUUCAUUGUCUCAGUNN | 4239 | ACUGAGACAAUGAAUUCAGNN | 4240 |
| NM_013842_702-720 | CCCAGAGGUCUACCCAGAANN | 3383 | UUCUGGGUAGACCUCUGGGNN | 3384 |
| NM_013842_926-944 | AAUUCAUUGUCUCAGUGAANN | 3551 | UUCACUGAGACAAUGAAUUNN | 3552 |
| NM_013842_391-409 | UGAGAACCAGGAGUUAAGANN | 3237 | UCUUAACUCCUGGUUCUCANN | 3238 |
| NM_013842_775-793 | AAGCUGGAAGCCAUUAAUGNN | 3451 | CAUUAAUGGCUUCCAGCUUNN | 3452 |
| NM_013842_1150-1168 | CCCCAGCUGAUUAGUGUCUNN | 2325 | AGACACUAAUCAGCUGGGGNN | 2326 |
| NM_013842_776-794 | AGCUGGAAGCCAUUAAUGNN | 3453 | UCAUUAAUGGCUUCCAGCUNN | 3454 |
| NM_013842_921-939 | CCCUGAAUUCAUUGUCUCANN | 3545 | UGAGACAAUGAAUUCAGGGNN | 3546 |
| NM_013842_777-795 | GCUGGAAGCCAUUAAUGAANN | 3787 | UUCAUUAAUGGCUUCCAGCNN | 3788 |
| NM_013842_539-557 | GUGCAGGCCCAGUUGUCACNN | 4153 | GUGACAACUGGGCCUGCACNN | 4154 |
| NM_013842_731-749 | CCUUACCAGCCUCCCUUUCNN | 4197 | GAAAGGGAGGCUGGUAAGGNN | 4198 |
| NM_013842_924-942 | UGAAUUCAUUGUCUCAGUGNN | 4241 | CACUGAGACAAUGAAUUCANN | 4242 |
| NM_013842_1151-1169 | CCCAGCUGAUUAGUGUCUANN | 2245 | UAGACACUAAUCAGCUGGGNN | 2246 |
| NM_013842_1152-1170 | CCAGCUGAUUAGUGUCUAANN | 2327 | UUAGACACUAAUCAGCUGGNN | 2328 |
| NM_013842_1718-1736 | ACUAUGUAAAUGCUUGAUGNN | 2681 | CAUCAAGCAUUUACAUAGUNN | 2682 |
| NM_013842_368-386 | GAGAAAACUCACGGCCUUGNN | 4323 | CAAGGCCGUGAGUUUUCUCNN | 4324 |
| NM_013842_489-507 | CCGGGUCUGCUGAGUCCGCNN | 2701 | GCGGACUCAGCAGACCCGGNN | 2702 |
| NM_013842_238-256 | ACUGAAAACAGAGUAGCANN | 2491 | UGCUACUCUGUUUUUCAGUNN | 2492 |

TABLE 12-continued

XBP-1 mouse/Rhesus siRNAs with 3'dinucleotide overhangs

| Target sequence on rhesus mRNA transcript 5' to 3' | sense (5'-3') with 3' dinucleotide overhand | SEQ ID NO: | antisense (5'-3') with 3' dinucleotide overhang | SEQ ID NO: |
|---|---|---|---|---|
| NM_013842_240-258 | UGAAAAACAGAGUAGCAGCNN | 2731 | GCUGCUACUCUGUUUUUCANN | 2732 |
| NM_013842_390-408 | UUGAGAACCAGGAGUUAAGNN | 2531 | CUUAACUCCUGGUUCUCAANN | 2532 |
| NM_013842_487-505 | GGCCGGGUCUGCUGAGUCCNN | 2771 | GGACUCAGCAGACCCGGCCNN | 2772 |
| NM_013842_741-759 | CUCCCUUUCUCUGUCAGUGNN | 4257 | CACUGACAGAGAAAGGGAGNN | 4258 |
| NM_013842_918-936 | UCACCCUGAAUUCAUUGUCNN | 2359 | GACAAUGAAUUCAGGGUGANN | 2360 |
| NM_013842_919-937 | CACCCUGAAUUCAUUGUCUNN | 2545 | AGACAAUGAAUUCAGGGUGNN | 2546 |
| NM_013842_1130-1148 | CUUUUGCCAAUGAACUUUUNN | 4325 | AAAAGUUCAUUGGCAAAAGNN | 4326 |
| NM_013842_1712-1730 | AAAUUUACUAUGUAAAUGCNN | 3047 | GCAUUUACAUAGUAAAUUUNN | 3048 |
| NM_013842_1714-1732 | AUUUACUAUGUAAAUGCUUNN | 3049 | AAGCAUUUACAUAGUAAAUNN | 3050 |
| NM_013842_1717-1735 | UACUAUGUAAAUGCUUGAUNN | 3053 | AUCAAGCAUUUACAUAGUANN | 3054 |
| NM_013842_1719-1737 | CUAUGUAAAUGCUUGAUGGNN | 3055 | CCAUCAAGCAUUUACAUAGNN | 3056 |
| NM_013842_1775-1793 | CCAUUUAUUUAAAACUACCNN | 2581 | GGUAGUUUUAAAUAAAUGGNN | 2582 |
| NM_013842_1776-1794 | CAUUUAUUUAAAACUACCCNN | 2583 | GGGUAGUUUUAAAUAAAUGNN | 2584 |
| NM_013842_239-257 | CUGAAAAACAGAGUAGCAGNN | 2585 | CUGCUACUCUGUUUUUCAGNN | 2586 |
| NM_013842_347-365 | CUAGAAAAUCAGCUUUUACNN | 3215 | GUAAAAGCUGAUUUUCUAGNN | 3216 |
| NM_013842_348-366 | UAGAAAAUCAGCUUUUACGNN | 3881 | CGUAAAAGCUGAUUUUCUANN | 3882 |
| NM_013842_485-503 | GUGGCCGGGUCUGCUGAGUNN | 3265 | ACUCAGCAGACCCGGCCACNN | 3266 |
| NM_013842_486-504 | UGGCCGGGUCUGCUGAGUCNN | 3267 | GACUCAGCAGACCCGGCCANN | 3268 |
| NM_013842_488-506 | GCCGGGUCUGCUGAGUCCGNN | 3269 | CGGACUCAGCAGACCCGGCNN | 3270 |
| NM_013842_540-558 | UGCAGGCCCAGUUGUCACCNN | 3897 | GGUGACAACUGGGCCUGCANN | 3898 |
| NM_013842_703-721 | CCAGAGGUCUACCCAGAAGNN | 3385 | CUUCGGGUAGACCUCUGGNN | 3386 |
| NM_013842_705-723 | AGAGGUCUACCCAGAAGGANN | 3387 | UCCUUCUGGGUAGACCUCUNN | 3388 |
| NM_013842_730-748 | UCCUUACCAGCCUCCCUUUNN | 3919 | AAAGGGAGGCUGGUAAGGANN | 3920 |
| NM_013842_742-760 | UCCCUUUCUCUGUCAGUGGNN | 3923 | CCACUGACAGAGAAAGGGANN | 3924 |
| NM_013842_744-762 | CCUUUCUCUGUCAGUGGGGNN | 3423 | CCCCACUGACAGAGAAAGGNN | 3424 |
| NM_013842_767-785 | CAUCAGCCAAGCUGGAAGCNN | 3925 | GCUUCCAGCUUGGCUGAUGNN | 3926 |
| NM_013842_771-789 | AGCCAAGCUGGAAGCCAUUNN | 3443 | AAUGGCUUCCAGCUUGGCUNN | 3444 |
| NM_013842_916-934 | GAUCACCCUGAAUUCAUUGNN | 2397 | CAAUGAAUUCAGGGUGAUCNN | 2398 |
| NM_013842_920-938 | ACCCUGAAUUCAUUGUCUCNN | 3543 | GAGACAAUGAAUUCAGGGUNN | 3544 |
| NM_013842_922-940 | CCUGAAUUCAUUGUCUCAGNN | 3547 | CUGAGACAAUGAAUUCAGGNN | 3548 |
| NM_013842_925-943 | GAAUUCAUUGUCUCAGUGANN | 3549 | UCACUGAGACAAUGAAUUCNN | 3550 |
| NM_013842_1720-1738 | UAUGUAAAUGCUUGAUGGANN | 4043 | UCCAUCAAGCAUUUACAUANN | 4044 |
| NM_013842_232-250 | GAGGAAACUGAAAAACAGANN | 4113 | UCUGUUUUUCAGUUUCCUCNN | 4114 |
| NM_013842_236-254 | AAACUGAAAAACAGAGUAGNN | 4115 | CUACUCUGUUUUUCAGUUUNN | 4116 |
| NM_013842_728-746 | GUUCCUUACCAGCCUCCCUNN | 4193 | AGGGAGGCUGGUAAGGAACNN | 4194 |
| NM_013842_729-747 | UUCCUUACCAGCCUCCCUUNN | 4195 | AAGGGAGGCUGGUAAGGAANN | 4196 |
| NM_013842_745-763 | CUUUCUCUGUCAGUGGGGANN | 4203 | UCCCCACUGACAGAGAAAGNN | 4204 |

TABLE 12-continued

XBP-1 mouse/Rhesus siRNAs with 3'dinucleotide overhangs

| Target sequence on rhesus mRNA transcript 5' to 3' | sense (5'-3') with 3' dinucleotide overhand | SEQ ID NO: | antisense (5'-3') with 3' dinucleotide overhang | SEQ ID NO: |
|---|---|---|---|---|
| NM_013842_766-784 | UCAUCAGCCAAGCUGGAAGNN | 3675 | CUUCCAGCUUGGCUGAUGANN | 3676 |
| NM_013842_927-945 | AUUCAUUGUCUCAGUGAAGNN | 4243 | CUUCACUGAGACAAUGAAUNN | 4244 |
| NM_013842_234-252 | GGAAACUGAAAAACAGAGUNN | 4295 | ACUCUGUUUUUCAGUUUCCNN | 4296 |
| NM_013842_235-253 | GAAACUGAAAAACAGAGUANN | 4297 | UACUCUGUUUUUCAGUUUCNN | 4298 |
| NM_013842_346-364 | GCUAGAAAAUCAGCUUUUANN | 4301 | UAAAAGCUGAUUUUCUAGCNN | 4302 |
| NM_013842_490-508 | CGGGUCUGCUGAGUCCGCANN | 2703 | UGCGGACUCAGCAGACCCGNN | 2704 |
| NM_013842_700-718 | CUCCCAGAGGUCUACCCAGNN | 2293 | CUGGGUAGACCUCUGGGAGNN | 2294 |
| NM_013842_1715-1733 | UUUACUAUGUAAAUGCUUGNN | 3051 | CAAGCAUUUACAUAGUAAANN | 3052 |
| NM_013842_734-752 | UACCAGCCUCCCUUUCUCUNN | 3419 | AGAGAAAGGGAGGCUGGUANN | 3420 |
| NM_013842_773-791 | CCAAGCUGGAAGCCAUUAANN | 3447 | UUAAUGGCUUCCAGCUUGGNN | 3448 |
| NM_013842_778-796 | CUGGAAGCCAUUAAUGAACNN | 3455 | GUUCAUUAAUGGCUUCCAGNN | 3456 |
| NM_013842_779-797 | UGGAAGCCAUUAAUGAACUNN | 3457 | AGUUCAUUAAUGGCUUCCANN | 3458 |
| NM_013842_1774-1792 | UCCAUUUAUUUAAAACUACNN | 4055 | GUAGUUUUAAAUAAAUGGANN | 4056 |
| NM_013842_704-722 | CAGAGGUCUACCCAGAAGGNN | 4189 | CCUUCUGGGUAGACCUCUGNN | 4190 |
| NM_013842_1716-1734 | UUACUAUGUAAAUGCUUGANN | 2679 | UCAAGCAUUUACAUAGUAANN | 2680 |
| NM_013842_1713-1731 | AAUUUACUAUGUAAAUGCUNN | 2517 | AGCAUUUACAUAGUAAAUUNN | 2518 |
| NM_013842_768-786 | AUCAGCCAAGCUGGAAGCCNN | 4259 | GGCUUCCAGCUUGGCUGAUNN | 4260 |
| NM_013842_1129-1147 | ACUUUUGCCAAUGAACUUUNN | 4327 | AAAGUUCAUUGGCAAAAGUNN | 4328 |
| NM_013842_389-407 | GUUGAGAACCAGGAGUUAANN | 2447 | UUAACUCCUGGUUCUCAACNN | 2448 |
| NM_013842_701-719 | UCCCAGAGGUCUACCCAGANN | 3381 | UCUGGGUAGACCUCUGGGANN | 3382 |
| NM_013842_706-724 | GAGGUCUACCCAGAAGGACNN | 3389 | GUCCUUCGGGUAGACCUCNN | 3390 |
| NM_013842_707-725 | AGGUCUACCCAGAAGGACCNN | 3391 | GGUCCUUCUGGGUAGACCUNN | 3392 |
| NM_013842_727-745 | AGUUCCUUACCAGCCUCCCNN | 3415 | GGGAGGCUGGUAAGGAACUNN | 3416 |
| NM_013842_733-751 | UUACCAGCCUCCCUUUCUCNN | 3921 | GAGAAAGGGAGGCUGGUAANN | 3922 |
| NM_013842_736-754 | CCAGCCUCCCUUUCUCUGUNN | 3695 | ACAGAGAAAGGGAGGCUGGNN | 3696 |
| NM_013842_738-756 | AGCCUCCCUUUCUCUGUCANN | 3421 | UGACAGAGAAAGGGAGGCUNN | 3422 |
| NM_013842_743-761 | CCCUUUCUCUGUCAGUGGNN | 3749 | CCCACUGACAGAGAAAGGGNN | 3750 |
| NM_013842_769-787 | UCAGCCAAGCUGGAAGCCANN | 3441 | UGGCUUCCAGCUUGGCUGANN | 3442 |
| NM_013842_772-790 | GCCAAGCUGGAAGCCAUUANN | 3445 | UAAUGGCUUCCAGCUUGGCNN | 3446 |
| NM_013842_774-792 | CAAGCUGGAAGCCAUUAAUNN | 3449 | AUUAAUGGCUUCCAGCUUGNN | 3450 |
| NM_013842_231-249 | GGAGGAAACUGAAAAACAGNN | 4111 | CUGUUUUUCAGUUUCCUCCNN | 4112 |
| NM_013842_233-251 | AGGAAACUGAAAAACAGAGNN | 4275 | CUCUGUUUUUCAGUUUCCUNN | 4276 |
| NM_013842_735-753 | ACCAGCCUCCCUUUCUCUGNN | 4199 | CAGAGAAAGGGAGGCUGGUNN | 4200 |
| NM_013842_737-755 | CAGCCUCCCUUUCUCUGUCNN | 3673 | GACAGAGAAAGGGAGGCUGNN | 3674 |
| NM_013842_739-757 | GCCUCCCUUUCUCUGUCAGNN | 4201 | CUGACAGAGAAAGGGAGGCNN | 4202 |
| NM_013842_740-758 | CCUCCCUUUCUCUGUCAGUNN | 4279 | ACUGACAGAGAAAGGGAGGNN | 4280 |

TABLE 12-continued

XBP-1 mouse/Rhesus siRNAs with 3'dinucleotide overhangs

| Target sequence on rhesus mRNA transcript 5' to 3' | sense (5'-3') with 3' dinucleotide overhand | SEQ ID NO: | antisense (5'-3') with 3' dinucleotide overhang | SEQ ID NO: |
|---|---|---|---|---|
| NM_013842_746-764 | UUUCUCUGUCAGUGGGGACNN | 4205 | GUCCCCACUGACAGAGAAANN | 4206 |
| NM_013842_770-788 | CAGCCAAGCUGGAAGCCAUNN | 4207 | AUGGCUUCCAGCUUGGCUGNN | 4208 |
| NM_013842_26-44 | GCUAUGGUGGUGGUGGCAGNN | 4281 | CUGCCACCACCACCAUAGCNN | 4282 |
| NM_013842_27-45 | CUAUGGUGGUGGUGGCAGCNN | 4217 | GCUGCCACCACCACCAUAGNN | 4218 |
| NM_013842_732-750 | CUUACCAGCCUCCCUUUCUNN | 3417 | AGAAAGGGAGGCUGGUAAGNN | 3418 |

Gene XBP-1
reference transcript NM_013842 (*Mus musculus* XPB 1 mRNA, FIG. 3)
Notes
100 siRNA sequences common to both mouse and rhesus

TABLE 13

XBP-1 mouse/Rhesus analysis of siRNAs

| | off target | | | | | | | |
|---|---|---|---|---|---|---|---|---|
| | mouse | | | | rhesus | | | |
| Oligo Name | Antisense Count | Antisense Score | Sense Count | Sense Score | Antisense Count | Antisense Score | Sense Count | Sense Score |
|---|---|---|---|---|---|---|---|---|
| NM_013842_369-387 | 4 | 3.2 | 2 | 2 | 1 | 2.8 | 1 | 2.4 |
| NM_013842_237-255 | 3 | 3 | 1 | 2 | 2 | 2.2 | 14 | 1 |
| NM_013842_491-509 | 1 | 3 | 1 | 2 | 1 | 2 | 5 | 2.2 |
| NM_013842_917-935 | 9 | 3 | 1 | 2 | 1 | 2 | 5 | 2 |
| NM_013842_923-941 | 7 | 3 | 2 | 1 | 1 | 1 | 1 | 1 |
| NM_013842_702-720 | 2 | 2.8 | 8 | 2 | 4 | 2 | 1 | 2 |
| NM_013842_926-944 | 2 | 2.8 | 1 | 1 | 1 | 2 | 3 | 2 |
| NM_013842_391-409 | 2 | 2.4 | 7 | 3 | 1 | 2 | 1 | 2 |
| NM_013842_775-793 | 2 | 2.4 | 5 | 2 | 3 | 2 | 2 | 2 |
| NM_013842_1150-1168 | 3 | 2.2 | 1 | 2 | 1 | 2.8 | 1 | 2 |
| NM_013842_776-794 | 3 | 2.2 | 6 | 2 | 1 | 2 | 1 | 1 |
| NM_013842_921-939 | 1 | 2.2 | 1 | 2 | 2 | 2 | 4 | 2 |
| NM_013842_777-795 | 6 | 2.2 | 3 | 2 | 1 | 1.2 | 4 | 2 |
| NM_013842_539-557 | 2 | 2.2 | 4 | 2 | 5 | 1 | 4 | 2.2 |
| NM_013842_731-749 | 3 | 2.2 | 4 | 2.8 | 1 | 1 | 1 | 1 |
| NM_013842_924-942 | 2 | 2.2 | 3 | 2 | 1 | 1 | 1 | 2 |
| NM_013842_1151-1169 | 1 | 2 | 1 | 2.2 | 2 | 3 | 1 | 1.2 |
| NM_013842_1152-1170 | 1 | 2 | 1 | 2 | 2 | 3 | 2 | 2.2 |
| NM_013842_1718-1736 | 1 | 2 | 5 | 3 | 20 | 3 | 1 | 2.2 |
| NM_013842_368-386 | 1 | 2 | 2 | 2 | 1 | 3 | 1 | 2.2 |
| NM_013842_489-507 | 1 | 2 | 1 | 2 | 3 | 3 | 4 | 3 |
| NM_013842_238-256 | 1 | 2 | 10 | 3 | 1 | 2.4 | 2 | 1 |
| NM_013842_240-258 | 1 | 2 | 4 | 2 | 1 | 2.4 | 10 | 2 |
| NM_013842_390-408 | 2 | 2 | 18 | 3 | 4 | 2.2 | 1 | 1 |
| NM_013842_487-505 | 1 | 2 | 3 | 2 | 1 | 2.2 | 5 | 2 |
| NM_013842_741-759 | 3 | 2 | 2 | 1 | 1 | 2.2 | 2 | 1.2 |
| NM_013842_918-936 | 1 | 2 | 1 | 2 | 2 | 2.2 | 5 | 2 |
| NM_013842_919-937 | 2 | 2 | 2 | 2 | 3 | 2.2 | 1 | 1 |
| NM_013842_1130-1148 | 1 | 2 | 2 | 2 | 12 | 2 | 1 | 1 |
| NM_013842_1712-1730 | 4 | 2 | 1 | 2 | 10 | 2 | 1 | 2.2 |
| NM_013842_1714-1732 | 2 | 2 | 1 | 2 | 1 | 2 | 2 | 1 |
| NM_013842_1717-1735 | 4 | 2 | 6 | 3 | 2 | 2 | 1 | 2.2 |
| NM_013842_1719-1737 | 1 | 2 | 1 | 2 | 13 | 2 | 2 | 2 |
| NM_013842_1775-1793 | 2 | 2 | 4 | 2 | 2 | 2 | 9 | 2 |
| NM_013842_1776-1794 | 1 | 2 | 4 | 2 | 4 | 2 | 1 | 1 |
| NM_013842_239-257 | 9 | 2 | 3 | 2 | 1 | 2 | 2 | 1 |
| NM_013842_347-365 | 2 | 2 | 3 | 2 | 1 | 2 | 1 | 1 |
| NM_013842_348-366 | 3 | 2 | 5 | 2.2 | 1 | 2 | 1 | 1 |
| NM_013842_485-503 | 2 | 2 | 1 | 2.2 | 13 | 2 | 3 | 2 |
| NM_013842_486-504 | 2 | 2 | 1 | 2 | 11 | 2 | 2 | 2 |
| NM_013842_488-506 | 5 | 2 | 5 | 3 | 2 | 2 | 2 | 2 |
| NM_013842_540-558 | 6 | 2 | 4 | 2 | 2 | 2 | 1 | 2 |
| NM_013842_703-721 | 2 | 2 | 8 | 2 | 7 | 2 | 3 | 2.2 |

TABLE 13-continued

XBP-1 mouse/Rhesus analysis of siRNAs

| | off target | | | | | | | |
|---|---|---|---|---|---|---|---|---|
| | mouse | | | | rhesus | | | |
| Oligo Name | Antisense Count | Antisense Score | Sense Count | Sense Score | Antisense Count | Antisense Score | Sense Count | Sense Score |
| NM_013842_705-723 | 6 | 2 | 5 | 2.8 | 5 | 2 | 1 | 3 |
| NM_013842_730-748 | 2 | 2 | 1 | 2.8 | 2 | 2 | 1 | 2.8 |
| NM_013842_742-760 | 3 | 2 | 1 | 1 | 2 | 2 | 5 | 2 |
| NM_013842_744-762 | 3 | 2 | 1 | 1 | 21 | 2 | 9 | 2 |
| NM_013842_767-785 | 6 | 2 | 6 | 2.2 | 7 | 2 | 3 | 2 |
| NM_013842_771-789 | 7 | 2 | 3 | 1 | 11 | 2 | 5 | 2 |
| NM_013842_916-934 | 1 | 2 | 4 | 2.2 | 6 | 2 | 4 | 2 |
| NM_013842_920-938 | 1 | 2 | 3 | 2 | 4 | 2 | 3 | 2 |
| NM_013842_922-940 | 3 | 2 | 2 | 1 | 1 | 2 | 2 | 2.2 |
| NM_013842_925-943 | 1 | 2 | 1 | 2 | 2 | 2 | 1 | 1 |
| NM_013842_1720-1738 | 1 | 2 | 1 | 2.2 | 4 | 1 | 1 | 3 |
| NM_013842_232-250 | 7 | 2 | 1 | 1 | 3 | 1 | 1 | 2 |
| NM_013842_236-254 | 1 | 2 | 2 | 2 | 2 | 1 | 1 | 1 |
| NM_013842_728-746 | 22 | 2 | 2 | 2 | 6 | 1 | 1 | 2 |
| NM_013842_729-747 | 13 | 2 | 1 | 2.2 | 3 | 1 | 1 | 2.2 |
| NM_013842_745-763 | 4 | 2 | 2 | 1 | 20 | 1 | 1 | 1 |
| NM_013842_766-784 | 2 | 2 | 8 | 2 | 1 | 1 | 2 | 1 |
| NM_013842_927-945 | 2 | 2 | 5 | 2 | 1 | 1 | 1 | 1 |
| NM_013842_234-252 | 6 | 2 | 1 | 1 | 1 | 0 | 2 | 1 |
| NM_013842_235-253 | 2 | 2 | 1 | 1 | 1 | 0 | 1 | 1 |
| NM_013842_346-364 | 2 | 2 | 1 | 1 | 1 | 0 | 3 | 2 |
| NM_013842_490-508 | 1 | 1.2 | 12 | 3 | 6 | 3 | 3 | 2 |
| NM_013842_700-718 | 1 | 1.2 | 3 | 2.2 | 4 | 3 | 2 | 2 |
| NM_013842_1715-1733 | 1 | 1.2 | 6 | 3 | 3 | 2 | 1 | 1 |
| NM_013842_734-752 | 1 | 1.2 | 1 | 1 | 7 | 2 | 5 | 2 |
| NM_013842_773-791 | 2 | 1.2 | 1 | 2 | 1 | 2 | 1 | 2.2 |
| NM_013842_778-796 | 1 | 1.2 | 3 | 2 | 7 | 2 | 2 | 2 |
| NM_013842_779-797 | 1 | 1.2 | 5 | 3 | 1 | 2 | 1 | 2 |
| NM_013842_1774-1792 | 1 | 1.2 | 1 | 1 | 1 | 1 | 4 | 2 |
| NM_013842_704-722 | 2 | 1.2 | 1 | 2 | 4 | 1 | 1 | 2.2 |
| NM_013842_1716-1734 | 1 | 1 | 5 | 3 | 9 | 3 | 1 | 1 |
| NM_013842_1713-1731 | 1 | 1 | 1 | 2.2 | 3 | 2.2 | 2 | 2 |
| NM_013842_768-786 | 1 | 1 | 2 | 2.2 | 2 | 2.2 | 4 | 2 |
| NM_013842_1129-1147 | 1 | 1 | 2 | 2 | 1 | 2 | 1 | 1 |
| NM_013842_389-407 | 1 | 1 | 2 | 2 | 1 | 2 | 3 | 2 |
| NM_013842_701-719 | 2 | 1 | 1 | 1 | 4 | 2 | 4 | 2 |
| NM_013842_706-724 | 3 | 1 | 6 | 2 | 1 | 2 | 1 | 3 |
| NM_013842_707-725 | 2 | 1 | 1 | 1 | 3 | 2 | 1 | 3 |
| NM_013842_727-745 | 1 | 1 | 1 | 2 | 1 | 2 | 1 | 2.2 |
| NM_013842_733-751 | 2 | 1 | 1 | 2.2 | 2 | 2 | 3 | 2 |
| NM_013842_736-754 | 1 | 1 | 3 | 2 | 3 | 2 | 6 | 1 |
| NM_013842_738-756 | 2 | 1 | 7 | 2 | 7 | 2 | 3 | 1 |
| NM_013842_743-761 | 1 | 1 | 2 | 2 | 4 | 2 | 2 | 2 |
| NM_013842_769-787 | 1 | 1 | 2 | 2 | 8 | 2 | 2 | 0 |
| NM_013842_772-790 | 3 | 1 | 4 | 2 | 1 | 2 | 2 | 2 |
| NM_013842_774-792 | 2 | 1 | 2 | 2 | 4 | 2 | 10 | 2 |
| NM_013842_231-249 | 2 | 1 | 1 | 1.2 | 1 | 1 | 2 | 2 |
| NM_013842_233-251 | 4 | 1 | 4 | 2 | 2 | 1 | 2 | 2 |
| NM_013842_735-753 | 3 | 1 | 2 | 1 | 1 | 1 | 4 | 2 |
| NM_013842_737-755 | 4 | 1 | 3 | 2 | 1 | 1 | 7 | 2 |
| NM_013842_739-757 | 2 | 1 | 6 | 2 | 4 | 1 | 1 | 1 |
| NM_013842_740-758 | 1 | 1 | 9 | 2 | 1 | 1 | 1 | 1 |
| NM_013842_746-764 | 2 | 1 | 1 | 1 | 20 | 1 | 8 | 2 |
| NM_013842_770-788 | 2 | 1 | 4 | 1 | 1 | 1 | 3 | 1 |
| NM_013842_26-44 | 4 | 1 | 1 | 1 | 15 | 1 | 9 | 1 |
| NM_013842_27-45 | 2 | 1 | 2 | 2 | 10 | 1 | 1 | 1 |
| NM_013842_732-750 | 1 | 0 | 2 | 2.8 | 5 | 2 | 1 | 1 |

Gene XBP-1
reference transcript NM_013842 (*Mus musculis* XPB1 mRNA, FIG. 3)
Notes
100 siRNA sequences common to both mouse and rhesus Other embodiments are in the claims.

---

SEQUENCE LISTING (4337 sequences)

SEQ ID NO: 1 - RNA, 19 nt, Artificial Sequence
  Description of Artificial Sequence: Synthetic oligonucleotide
agaaaaucagcuuuuacga

SEQ ID NO: 2 - RNA, 19 nt, Artificial Sequence
  Description of Artificial Sequence: Synthetic oligonucleotide
ucguaaaagcugauuuucu

SEQ ID NO: 3 - RNA, 19 nt, Artificial Sequence
  Description of Artificial Sequence: Synthetic oligonucleotide
uccccagcugauuaguguc

SEQ ID NO: 4 - RNA, 19 nt, Artificial Sequence
  Description of Artificial Sequence: Synthetic oligonucleotide
gacacuaaucagcugggga

SEQ ID NO: 5 - RNA, 19 nt, Artificial Sequence
  Description of Artificial Sequence: Synthetic oligonucleotide
uacuuauuauguaaggguc

SEQ ID NO: 6 - RNA, 19 nt, Artificial Sequence
  Description of Artificial Sequence: Synthetic oligonucleotide
gacccuuacauaauaagua

SEQ ID NO: 7 - RNA, 19 nt, Artificial Sequence
  Description of Artificial Sequence: Synthetic oligonucleotide
uaucuuaaaagggugguag

SEQ ID NO: 8 - RNA, 19 nt, Artificial Sequence
  Description of Artificial Sequence: Synthetic oligonucleotide
cuaccacccuuuuaagaua

SEQ ID NO: 9 - RNA, 19 nt, Artificial Sequence
  Description of Artificial Sequence: Synthetic oligonucleotide
ccauggauucuggcgguau

SEQ ID NO: 10 - RNA, 19 nt, Artificial Sequence
  Description of Artificial Sequence: Synthetic oligonucleotide
auaccgccagaauccaugg

SEQ ID NO: 11 - RNA, 19 nt, Artificial Sequence
  Description of Artificial Sequence: Synthetic oligonucleotide
uuaaugaacuaauucguuu

SEQ ID NO: 12 - RNA, 19 nt, Artificial Sequence
  Description of Artificial Sequence: Synthetic oligonucleotide
aaacgaauuaguucauuaa

SEQ ID NO: 13 - RNA, 19 nt, Artificial Sequence
  Description of Artificial Sequence: Synthetic oligonucleotide
agggucauuagacaaaugu

SEQ ID NO: 14 - RNA, 19 nt, Artificial Sequence
  Description of Artificial Sequence: Synthetic oligonucleotide
acauuugucuaaugacccu

SEQ ID NO: 15 - RNA, 19 nt, Artificial Sequence
  Description of Artificial Sequence: Synthetic oligonucleotide
ugaacuaauucguuuugac

SEQ ID NO: 16 - RNA, 19 nt, Artificial Sequence
  Description of Artificial Sequence: Synthetic oligonucleotide
gucaaaacgaauuaguuca

SEQ ID NO: 17 - RNA, 19 nt, Artificial Sequence
  Description of Artificial Sequence: Synthetic oligonucleotide
uguaagggucauuagacaa

SEQ ID NO: 18 - RNA, 19 nt, Artificial Sequence
  Description of Artificial Sequence: Synthetic oligonucleotide
uugucuaaugacccuuaca

SEQ ID NO: 19 - RNA, 19 nt, Artificial Sequence
  Description of Artificial Sequence: Synthetic oligonucleotide
aacuaauucguuuugacca

SEQ ID NO: 20 - RNA, 19 nt, Artificial Sequence
  Description of Artificial Sequence: Synthetic oligonucleotide
uggucaaaacgaauuaguu

SEQ ID NO: 21 - RNA, 19 nt, Artificial Sequence
  Description of Artificial Sequence: Synthetic oligonucleotide
uauuuaaaacuacccaugc

SEQ ID NO: 22 - RNA, 19 nt, Artificial Sequence
  Description of Artificial Sequence: Synthetic oligonucleotide
gcauggguaguuuuaaaua

SEQ ID NO: 23 - RNA, 19 nt, Artificial Sequence
  Description of Artificial Sequence: Synthetic oligonucleotide
uuccccagcugauuagugu

SEQ ID NO: 24 - RNA, 19 nt, Artificial Sequence
  Description of Artificial Sequence: Synthetic oligonucleotide
acacuaaucagcuggggaa

SEQ ID NO: 25 - RNA, 19 nt, Artificial Sequence
  Description of Artificial Sequence: Synthetic oligonucleotide
uauguaagggucauuagac

SEQ ID NO: 26 - RNA, 19 nt, Artificial Sequence
  Description of Artificial Sequence: Synthetic oligonucleotide
gucuaaugacccuuacaua

SEQ ID NO: 27 - RNA, 19 nt, Artificial Sequence
  Description of Artificial Sequence: Synthetic oligonucleotide
guaagggucauuagacaaa

SEQ ID NO: 28 - RNA, 19 nt, Artificial Sequence
  Description of Artificial Sequence: Synthetic oligonucleotide
uuugucuaaugacccuuac

SEQ ID NO: 29 - RNA, 19 nt, Artificial Sequence
  Description of Artificial Sequence: Synthetic oligonucleotide
gcucccagaggucuaccca

SEQ ID NO: 30 - RNA, 19 nt, Artificial Sequence
  Description of Artificial Sequence: Synthetic oligonucleotide
uggguagaccucugggagc

SEQ ID NO: 31 - RNA, 19 nt, Artificial Sequence
  Description of Artificial Sequence: Synthetic oligonucleotide
gagccaagcuaauguggua

SEQ ID NO: 32 - RNA, 19 nt, Artificial Sequence
  Description of Artificial Sequence: Synthetic oligonucleotide
uaccacauuagcuuggcuc

SEQ ID NO: 33 - RNA, 19 nt, Artificial Sequence
  Description of Artificial Sequence: Synthetic oligonucleotide
cugccuacuggaugcuuac

SEQ ID NO: 34 - RNA, 19 nt, Artificial Sequence
  Description of Artificial Sequence: Synthetic oligonucleotide
guaagcauccaguaggcag

SEQ ID NO: 35 - RNA, 19 nt, Artificial Sequence
  Description of Artificial Sequence: Synthetic oligonucleotide
gccuacuggaugcuuacag

SEQ ID NO: 36 - RNA, 19 nt, Artificial Sequence
  Description of Artificial Sequence: Synthetic oligonucleotide
cuguaagcauccaguaggc

SEQ ID NO: 37 - RNA, 19 nt, Artificial Sequence
  Description of Artificial Sequence: Synthetic oligonucleotide
gcuugguguaaaccauucu

SEQ ID NO: 38 - RNA, 19 nt, Artificial Sequence
  Description of Artificial Sequence: Synthetic oligonucleotide
agaaugguuuacaccaagc

SEQ ID NO: 39 - RNA, 19 nt, Artificial Sequence
  Description of Artificial Sequence: Synthetic oligonucleotide
cuugguguaaaccauucuu

SEQ ID NO: 40 - RNA, 19 nt, Artificial Sequence
  Description of Artificial Sequence: Synthetic oligonucleotide
aagaaugguuuacaccaag

SEQ ID NO: 41 - RNA, 19 nt, Artificial Sequence
  Description of Artificial Sequence: Synthetic oligonucleotide
uuuccccagcugauuagug

SEQ ID NO: 42 - RNA, 19 nt, Artificial Sequence
  Description of Artificial Sequence: Synthetic oligonucleotide
cacuaaucagcuggggaaa

SEQ ID NO: 43 - RNA, 19 nt, Artificial Sequence
  Description of Artificial Sequence: Synthetic oligonucleotide
cccagcugauuagugucua

SEQ ID NO: 44 - RNA, 19 nt, Artificial Sequence
  Description of Artificial Sequence: Synthetic oligonucleotide
uagacacuaaucagcuggg

SEQ ID NO: 45 - RNA, 19 nt, Artificial Sequence
  Description of Artificial Sequence: Synthetic oligonucleotide
agcugauuagugucuaagg

SEQ ID NO: 46 - RNA, 19 nt, Artificial Sequence
  Description of Artificial Sequence: Synthetic oligonucleotide
ccuuagacacuaaucagcu

SEQ ID NO: 47 - RNA, 19 nt, Artificial Sequence
  Description of Artificial Sequence: Synthetic oligonucleotide
ugcccuuuuccuugacuau

SEQ ID NO: 48 - RNA, 19 nt, Artificial Sequence
  Description of Artificial Sequence: Synthetic oligonucleotide
auagucaaggaaaagggca

SEQ ID NO: 49 - RNA, 19 nt, Artificial Sequence
  Description of Artificial Sequence: Synthetic oligonucleotide
uuuuccuugacuauuacac

SEQ ID NO: 50 - RNA, 19 nt, Artificial Sequence
  Description of Artificial Sequence: Synthetic oligonucleotide
guguaauagucaaggaaaa

SEQ ID NO: 51 - RNA, 19 nt, Artificial Sequence
  Description of Artificial Sequence: Synthetic oligonucleotide
uugacuauuacacugccug

SEQ ID NO: 52 - RNA, 19 nt, Artificial Sequence
  Description of Artificial Sequence: Synthetic oligonucleotide
caggcaguguaauagucaa

SEQ ID NO: 53 - RNA, 19 nt, Artificial Sequence
  Description of Artificial Sequence: Synthetic oligonucleotide
ugacuauuacacugccugg

SEQ ID NO: 54 - RNA, 19 nt, Artificial Sequence
  Description of Artificial Sequence: Synthetic oligonucleotide
ccaggcaguguaauaguca

SEQ ID NO: 55 - RNA, 19 nt, Artificial Sequence
  Description of Artificial Sequence: Synthetic oligonucleotide
acuacagcuuuuaagauug

SEQ ID NO: 56 - RNA, 19 nt, Artificial Sequence
  Description of Artificial Sequence: Synthetic oligonucleotide
caaucuuaaaagcuguagu

SEQ ID NO: 57 - RNA, 19 nt, Artificial Sequence
  Description of Artificial Sequence: Synthetic oligonucleotide
acagcuuuuaagauuguac

SEQ ID NO: 58 - RNA, 19 nt, Artificial Sequence
  Description of Artificial Sequence: Synthetic oligonucleotide
guacaaucuuaaaagcugu

SEQ ID NO: 59 - RNA, 19 nt, Artificial Sequence
  Description of Artificial Sequence: Synthetic oligonucleotide
cagcuuuuaagauuguacu

SEQ ID NO: 60 - RNA, 19 nt, Artificial Sequence
  Description of Artificial Sequence: Synthetic oligonucleotide
aguacaaucuuaaaagcug

SEQ ID NO: 61 - RNA, 19 nt, Artificial Sequence
  Description of Artificial Sequence: Synthetic oligonucleotide
auacuuauuauguaagggu

SEQ ID NO: 62 - RNA, 19 nt, Artificial Sequence
  Description of Artificial Sequence: Synthetic oligonucleotide
acccuuacauaauaaguau

SEQ ID NO: 63 - RNA, 19 nt, Artificial Sequence
  Description of Artificial Sequence: Synthetic oligonucleotide
auguaagggucauuagaca

SEQ ID NO: 64 - RNA, 19 nt, Artificial Sequence
  Description of Artificial Sequence: Synthetic oligonucleotide
ugucuaaugacccuuacau

SEQ ID NO: 65 - RNA, 19 nt, Artificial Sequence
  Description of Artificial Sequence: Synthetic oligonucleotide
aagggucauuagacaaaug

SEQ ID NO: 66 - RNA, 19 nt, Artificial Sequence
  Description of Artificial Sequence: Synthetic oligonucleotide
cauuugucuaaugacccuu

SEQ ID NO: 67 - RNA, 19 nt, Artificial Sequence
  Description of Artificial Sequence: Synthetic oligonucleotide
uugccuccaguuuuagguc

SEQ ID NO: 68 - RNA, 19 nt, Artificial Sequence
  Description of Artificial Sequence: Synthetic oligonucleotide
gaccuaaaacuggaggcaa

SEQ ID NO: 69 - RNA, 19 nt, Artificial Sequence
  Description of Artificial Sequence: Synthetic oligonucleotide
aacuacccaugcaauuaaa

SEQ ID NO: 70 - RNA, 19 nt, Artificial Sequence
  Description of Artificial Sequence: Synthetic oligonucleotide
uuuaauugcauggguaguu

SEQ ID NO: 71 - RNA, 19 nt, Artificial Sequence
  Description of Artificial Sequence: Synthetic oligonucleotide
acugccagagaucgaaaga

SEQ ID NO: 72 - RNA, 19 nt, Artificial Sequence
  Description of Artificial Sequence: Synthetic oligonucleotide
ucuuucgaucucuggcagu

SEQ ID NO: 73 - RNA, 19 nt, Artificial Sequence
  Description of Artificial Sequence: Synthetic oligonucleotide
cugccagagaucgaaagaa

SEQ ID NO: 74 - RNA, 19 nt, Artificial Sequence
  Description of Artificial Sequence: Synthetic oligonucleotide
uucuuucgaucucuggcag

SEQ ID NO: 75 - RNA, 19 nt, Artificial Sequence
  Description of Artificial Sequence: Synthetic oligonucleotide
aucagcuuuuacgagagaa

SEQ ID NO: 76 - RNA, 19 nt, Artificial Sequence
  Description of Artificial Sequence: Synthetic oligonucleotide
uucucucguaaaagcugau

SEQ ID NO: 77 - RNA, 19 nt, Artificial Sequence
  Description of Artificial Sequence: Synthetic oligonucleotide
cccauggauucuggcggua

SEQ ID NO: 78 - RNA, 19 nt, Artificial Sequence
  Description of Artificial Sequence: Synthetic oligonucleotide
uaccgccagaauccauggg

SEQ ID NO: 79 - RNA, 19 nt, Artificial Sequence
  Description of Artificial Sequence: Synthetic oligonucleotide
cauggauucuggcgguauu

SEQ ID NO: 80 - RNA, 19 nt, Artificial Sequence
  Description of Artificial Sequence: Synthetic oligonucleotide
aauaccgccagaauccaug

SEQ ID NO: 81 - RNA, 19 nt, Artificial Sequence
  Description of Artificial Sequence: Synthetic oligonucleotide
uucuggcgguauugacucu

SEQ ID NO: 82 - RNA, 19 nt, Artificial Sequence
  Description of Artificial Sequence: Synthetic oligonucleotide
agagucaauaccgccagaa

SEQ ID NO: 83 - RNA, 19 nt, Artificial Sequence
  Description of Artificial Sequence: Synthetic oligonucleotide
ggcgguauugacucuucag

SEQ ID NO: 84 - RNA, 19 nt, Artificial Sequence
  Description of Artificial Sequence: Synthetic oligonucleotide
cugaagagucaauaccgcc

SEQ ID NO: 85 - RNA, 19 nt, Artificial Sequence
  Description of Artificial Sequence: Synthetic oligonucleotide
uucagagucugauauccug

SEQ ID NO: 86 - RNA, 19 nt, Artificial Sequence
  Description of Artificial Sequence: Synthetic oligonucleotide
caggauaucagacucugaa

SEQ ID NO: 87 - RNA, 19 nt, Artificial Sequence
  Description of Artificial Sequence: Synthetic oligonucleotide
ucugauauccuguugggca

SEQ ID NO: 88 - RNA, 19 nt, Artificial Sequence
  Description of Artificial Sequence: Synthetic oligonucleotide
ugcccaacaggauaucaga

SEQ ID NO: 89 - RNA, 19 nt, Artificial Sequence
  Description of Artificial Sequence: Synthetic oligonucleotide
gauauccuguugggcauuc

SEQ ID NO: 90 - RNA, 19 nt, Artificial Sequence
  Description of Artificial Sequence: Synthetic oligonucleotide
gaaugcccaacaggauauc

SEQ ID NO: 91 - RNA, 19 nt, Artificial Sequence
  Description of Artificial Sequence: Synthetic oligonucleotide
cucccagaggucuacccag

SEQ ID NO: 92 - RNA, 19 nt, Artificial Sequence
  Description of Artificial Sequence: Synthetic oligonucleotide
cuggguagaccucugggag

SEQ ID NO: 93 - RNA, 19 nt, Artificial Sequence
  Description of Artificial Sequence: Synthetic oligonucleotide
gaaggacccaguuccuuac

SEQ ID NO: 94 - RNA, 19 nt, Artificial Sequence
  Description of Artificial Sequence: Synthetic oligonucleotide
guaaggaacuggguccuuc

SEQ ID NO: 95 - RNA, 19 nt, Artificial Sequence
  Description of Artificial Sequence: Synthetic oligonucleotide
ggggacgucaucagccaag

SEQ ID NO: 96 - RNA, 19 nt, Artificial Sequence
  Description of Artificial Sequence: Synthetic oligonucleotide
cuuggcugaugacgucccc

SEQ ID NO: 97 - RNA, 19 nt, Artificial Sequence
  Description of Artificial Sequence: Synthetic oligonucleotide
augaacuaauucguuuuga

SEQ ID NO: 98 - RNA, 19 nt, Artificial Sequence
  Description of Artificial Sequence: Synthetic oligonucleotide
ucaaaacgaauuaguucau

SEQ ID NO: 99 - RNA, 19 nt, Artificial Sequence
  Description of Artificial Sequence: Synthetic oligonucleotide
ucguuuugaccacauauau

SEQ ID NO: 100 - RNA, 19 nt, Artificial Sequence
  Description of Artificial Sequence: Synthetic oligonucleotide
auauauguggucaaaacga

SEQ ID NO: 101 - RNA, 19 nt, Artificial Sequence
  Description of Artificial Sequence: Synthetic oligonucleotide
uuugaccacauauauacca

SEQ ID NO: 102 - RNA, 19 nt, Artificial Sequence
  Description of Artificial Sequence: Synthetic oligonucleotide
ugguauauauguggucaaa

SEQ ID NO: 103 - RNA, 19 nt, Artificial Sequence
  Description of Artificial Sequence: Synthetic oligonucleotide
uugaccacauauauaccaa

SEQ ID NO: 104 - RNA, 19 nt, Artificial Sequence
  Description of Artificial Sequence: Synthetic oligonucleotide
uugguauauauguggucaa

SEQ ID NO: 105 - RNA, 19 nt, Artificial Sequence
  Description of Artificial Sequence: Synthetic oligonucleotide
acauauauaccaagccccu

SEQ ID NO: 106 - RNA, 19 nt, Artificial Sequence
  Description of Artificial Sequence: Synthetic oligonucleotide
aggggcuugguauauaugu

SEQ ID NO: 107 - RNA, 19 nt, Artificial Sequence
  Description of Artificial Sequence: Synthetic oligonucleotide
agccaagcuaaugugguag

SEQ ID NO: 108 - RNA, 19 nt, Artificial Sequence
  Description of Artificial Sequence: Synthetic oligonucleotide
cuaccacauuagcuuggcu

SEQ ID NO: 109 - RNA, 19 nt, Artificial Sequence
  Description of Artificial Sequence: Synthetic oligonucleotide
gccaagcuaaugugguagu

SEQ ID NO: 110 - RNA, 19 nt, Artificial Sequence
  Description of Artificial Sequence: Synthetic oligonucleotide
acuaccacauuagcuuggc

SEQ ID NO: 111 - RNA, 19 nt, Artificial Sequence
  Description of Artificial Sequence: Synthetic oligonucleotide
ccaagcuaaugugguagug

SEQ ID NO: 112 - RNA, 19 nt, Artificial Sequence
  Description of Artificial Sequence: Synthetic oligonucleotide
cacuaccacauuagcuugg

SEQ ID NO: 113 - RNA, 19 nt, Artificial Sequence
  Description of Artificial Sequence: Synthetic oligonucleotide
agcuaaugugguagugaaa

SEQ ID NO: 114 - RNA, 19 nt, Artificial Sequence
  Description of Artificial Sequence: Synthetic oligonucleotide
uuucacuaccacauuagcu

SEQ ID NO: 115 - RNA, 19 nt, Artificial Sequence
  Description of Artificial Sequence: Synthetic oligonucleotide
gguagugaaaaucgaggaa

SEQ ID NO: 116 - RNA, 19 nt, Artificial Sequence
  Description of Artificial Sequence: Synthetic oligonucleotide
uuccucgauuuucacuacc

SEQ ID NO: 117 - RNA, 19 nt, Artificial Sequence
  Description of Artificial Sequence: Synthetic oligonucleotide
aaucgaggaagcaccucuc

SEQ ID NO: 118 - RNA, 19 nt, Artificial Sequence
  Description of Artificial Sequence: Synthetic oligonucleotide
gagaggugcuuccucgauu

SEQ ID NO: 119 - RNA, 19 nt, Artificial Sequence
  Description of Artificial Sequence: Synthetic oligonucleotide
gccccucagagaaugauca

SEQ ID NO: 120 - RNA, 19 nt, Artificial Sequence
  Description of Artificial Sequence: Synthetic oligonucleotide
ugaucauucucugaggggc

SEQ ID NO: 121 - RNA, 19 nt, Artificial Sequence
  Description of Artificial Sequence: Synthetic oligonucleotide
ugaucacccugaauucauu

SEQ ID NO: 122 - RNA, 19 nt, Artificial Sequence
  Description of Artificial Sequence: Synthetic oligonucleotide
aaugaauucagggugauca

SEQ ID NO: 123 - RNA, 19 nt, Artificial Sequence
  Description of Artificial Sequence: Synthetic oligonucleotide
ccccagcugauuagugucu

SEQ ID NO: 124 - RNA, 19 nt, Artificial Sequence
  Description of Artificial Sequence: Synthetic oligonucleotide
agacacuaaucagcugggg

SEQ ID NO: 125 - RNA, 19 nt, Artificial Sequence
  Description of Artificial Sequence: Synthetic oligonucleotide
ccagcugauuagugucuaa

SEQ ID NO: 126 - RNA, 19 nt, Artificial Sequence
  Description of Artificial Sequence: Synthetic oligonucleotide
uuagacacuaaucagcugg

SEQ ID NO: 127 - RNA, 19 nt, Artificial Sequence
  Description of Artificial Sequence: Synthetic oligonucleotide
cuugggaggacacuuuugc

SEQ ID NO: 128 - RNA, 19 nt, Artificial Sequence
  Description of Artificial Sequence: Synthetic oligonucleotide
gcaaaaguguccucccaag

SEQ ID NO: 129 - RNA, 19 nt, Artificial Sequence
  Description of Artificial Sequence: Synthetic oligonucleotide
uaaaacuacccaugcaauu

SEQ ID NO: 130 - RNA, 19 nt, Artificial Sequence
  Description of Artificial Sequence: Synthetic oligonucleotide
aauugcauggguaguuuua

SEQ ID NO: 131 - RNA, 19 nt, Artificial Sequence
  Description of Artificial Sequence: Synthetic oligonucleotide
cuccccauggauucuggcg

SEQ ID NO: 132 - RNA, 19 nt, Artificial Sequence
  Description of Artificial Sequence: Synthetic oligonucleotide
cgccagaauccauggggag

SEQ ID NO: 133 - RNA, 19 nt, Artificial Sequence
  Description of Artificial Sequence: Synthetic oligonucleotide
uaucucaaaucugcuuuca

SEQ ID NO: 134 - RNA, 19 nt, Artificial Sequence
  Description of Artificial Sequence: Synthetic oligonucleotide
ugaaagcagauuugagaua

SEQ ID NO: 135 - RNA, 19 nt, Artificial Sequence
  Description of Artificial Sequence: Synthetic oligonucleotide
uggaugcuuacagugacug

SEQ ID NO: 136 - RNA, 19 nt, Artificial Sequence
  Description of Artificial Sequence: Synthetic oligonucleotide
cagucacuguaagcaucca

SEQ ID NO: 137 - RNA, 19 nt, Artificial Sequence
  Description of Artificial Sequence: Synthetic oligonucleotide
cuuuuccuugacuauuaca

SEQ ID NO: 138 - RNA, 19 nt, Artificial Sequence
  Description of Artificial Sequence: Synthetic oligonucleotide
uguaauagucaaggaaaag

SEQ ID NO: 139 - RNA, 19 nt, Artificial Sequence
  Description of Artificial Sequence: Synthetic oligonucleotide
uuuaucuuaaaaggguggu

SEQ ID NO: 140 - RNA, 19 nt, Artificial Sequence
  Description of Artificial Sequence: Synthetic oligonucleotide
accacccuuuuaagauaaa

SEQ ID NO: 141 - RNA, 19 nt, Artificial Sequence
  Description of Artificial Sequence: Synthetic oligonucleotide
acuuauuauguaaggguca

SEQ ID NO: 142 - RNA, 19 nt, Artificial Sequence
  Description of Artificial Sequence: Synthetic oligonucleotide
ugacccuuacauaauaagu

SEQ ID NO: 143 - RNA, 19 nt, Artificial Sequence
  Description of Artificial Sequence: Synthetic oligonucleotide
cuuauuauguaagggucau

SEQ ID NO: 144 - RNA, 19 nt, Artificial Sequence
  Description of Artificial Sequence: Synthetic oligonucleotide
augacccuuacauaauaag

SEQ ID NO: 145 - RNA, 19 nt, Artificial Sequence
  Description of Artificial Sequence: Synthetic oligonucleotide
uuauguaagggucauuaga

SEQ ID NO: 146 - RNA, 19 nt, Artificial Sequence
  Description of Artificial Sequence: Synthetic oligonucleotide
ucuaaugacccuuacauaa

SEQ ID NO: 147 - RNA, 19 nt, Artificial Sequence
  Description of Artificial Sequence: Synthetic oligonucleotide
ccugcugagggggcucuuu

SEQ ID NO: 148 - RNA, 19 nt, Artificial Sequence
  Description of Artificial Sequence: Synthetic oligonucleotide
aaagagcccccucagcagg

SEQ ID NO: 149 - RNA, 19 nt, Artificial Sequence
  Description of Artificial Sequence: Synthetic oligonucleotide
auagaaauuuacuauguaa

SEQ ID NO: 150 - RNA, 19 nt, Artificial Sequence
  Description of Artificial Sequence: Synthetic oligonucleotide
uuacauaguaaauuucuau

SEQ ID NO: 151 - RNA, 19 nt, Artificial Sequence
  Description of Artificial Sequence: Synthetic oligonucleotide
agacugccagagaucgaaa

SEQ ID NO: 152 - RNA, 19 nt, Artificial Sequence
  Description of Artificial Sequence: Synthetic oligonucleotide
uuucgaucucuggcagucu

SEQ ID NO: 153 - RNA, 19 nt, Artificial Sequence
  Description of Artificial Sequence: Synthetic oligonucleotide
uccccauggauucuggcgg

SEQ ID NO: 154 - RNA, 19 nt, Artificial Sequence
  Description of Artificial Sequence: Synthetic oligonucleotide
ccgccagaauccaugggga

SEQ ID NO: 155 - RNA, 19 nt, Artificial Sequence
  Description of Artificial Sequence: Synthetic oligonucleotide
uaaugaacuaauucguuuu

SEQ ID NO: 156 - RNA, 19 nt, Artificial Sequence
  Description of Artificial Sequence: Synthetic oligonucleotide
aaaacgaauuaguucauua

SEQ ID NO: 157 - RNA, 19 nt, Artificial Sequence
  Description of Artificial Sequence: Synthetic oligonucleotide
ucacccugaauucauuguc

SEQ ID NO: 158 - RNA, 19 nt, Artificial Sequence
  Description of Artificial Sequence: Synthetic oligonucleotide
gacaaugaauucaggguga

SEQ ID NO: 159 - RNA, 19 nt, Artificial Sequence
  Description of Artificial Sequence: Synthetic oligonucleotide
gagcuggguaucucaaauc

SEQ ID NO: 160 - RNA, 19 nt, Artificial Sequence
  Description of Artificial Sequence: Synthetic oligonucleotide
gauuugagauacccagcuc

SEQ ID NO: 161 - RNA, 19 nt, Artificial Sequence
  Description of Artificial Sequence: Synthetic oligonucleotide
uuuccuugacuauuacacu

SEQ ID NO: 162 - RNA, 19 nt, Artificial Sequence
  Description of Artificial Sequence: Synthetic oligonucleotide
aguguaauagucaaggaaa

SEQ ID NO: 163 - RNA, 19 nt, Artificial Sequence
  Description of Artificial Sequence: Synthetic oligonucleotide
uuccuugacuauuacacug

SEQ ID NO: 164 - RNA, 19 nt, Artificial Sequence
  Description of Artificial Sequence: Synthetic oligonucleotide
caguguaauagucaaggaa

SEQ ID NO: 165 - RNA, 19 nt, Artificial Sequence
  Description of Artificial Sequence: Synthetic oligonucleotide
aaagccaaaauagagagua

SEQ ID NO: 166 - RNA, 19 nt, Artificial Sequence
  Description of Artificial Sequence: Synthetic oligonucleotide
uacucucuauuuuggcuuu

SEQ ID NO: 167 - RNA, 19 nt, Artificial Sequence
  Description of Artificial Sequence: Synthetic oligonucleotide
auuuguucagaucucauag

SEQ ID NO: 168 - RNA, 19 nt, Artificial Sequence
  Description of Artificial Sequence: Synthetic oligonucleotide
cuaugagaucugaacaaau

SEQ ID NO: 169 - RNA, 19 nt, Artificial Sequence
  Description of Artificial Sequence: Synthetic oligonucleotide
uuuuaucuuaaaagggugg

SEQ ID NO: 170 - RNA, 19 nt, Artificial Sequence
  Description of Artificial Sequence: Synthetic oligonucleotide
ccacccuuuuaagauaaaa

SEQ ID NO: 171 - RNA, 19 nt, Artificial Sequence
  Description of Artificial Sequence: Synthetic oligonucleotide
guauacuucaaguaagauc

SEQ ID NO: 172 - RNA, 19 nt, Artificial Sequence
  Description of Artificial Sequence: Synthetic oligonucleotide
gaucuuacuugaaguauac

SEQ ID NO: 173 - RNA, 19 nt, Artificial Sequence
  Description of Artificial Sequence: Synthetic oligonucleotide
uauacuucaaguaagauca

SEQ ID NO: 174 - RNA, 19 nt, Artificial Sequence
  Description of Artificial Sequence: Synthetic oligonucleotide
ugaucuuacuugaaguaua

SEQ ID NO: 175 - RNA, 19 nt, Artificial Sequence
  Description of Artificial Sequence: Synthetic oligonucleotide
uggaauuuuuuccugcuag

SEQ ID NO: 176 - RNA, 19 nt, Artificial Sequence
  Description of Artificial Sequence: Synthetic oligonucleotide
cuagcaggaaaaaauucca

SEQ ID NO: 177 - RNA, 19 nt, Artificial Sequence
  Description of Artificial Sequence: Synthetic oligonucleotide
uuccugcuaguguagcuuc

SEQ ID NO: 178 - RNA, 19 nt, Artificial Sequence
  Description of Artificial Sequence: Synthetic oligonucleotide
gaagcuacacuagcaggaa

SEQ ID NO: 179 - RNA, 19 nt, Artificial Sequence
  Description of Artificial Sequence: Synthetic oligonucleotide
ccaugcaauuaaaagguac

SEQ ID NO: 180 - RNA, 19 nt, Artificial Sequence
  Description of Artificial Sequence: Synthetic oligonucleotide
guaccuuuuaauugcaugg

SEQ ID NO: 181 - RNA, 19 nt, Artificial Sequence
  Description of Artificial Sequence: Synthetic oligonucleotide
gaacagcaagugguagauu

SEQ ID NO: 182 - RNA, 19 nt, Artificial Sequence
  Description of Artificial Sequence: Synthetic oligonucleotide
aaucuaccacuugcuguuc

SEQ ID NO: 183 - RNA, 19 nt, Artificial Sequence
  Description of Artificial Sequence: Synthetic oligonucleotide
accaaaaacuuuugcuaga

SEQ ID NO: 184 - RNA, 19 nt, Artificial Sequence
  Description of Artificial Sequence: Synthetic oligonucleotide
ucuagcaaaaguuuuuggu

SEQ ID NO: 185 - RNA, 19 nt, Artificial Sequence
  Description of Artificial Sequence: Synthetic oligonucleotide
ccaaaaacuuuugcuagaa

SEQ ID NO: 186 - RNA, 19 nt, Artificial Sequence
  Description of Artificial Sequence: Synthetic oligonucleotide
uucuagcaaaaguuuuugg

SEQ ID NO: 187 - RNA, 19 nt, Artificial Sequence
  Description of Artificial Sequence: Synthetic oligonucleotide
ccccauggauucuggcggu

SEQ ID NO: 188 - RNA, 19 nt, Artificial Sequence
  Description of Artificial Sequence: Synthetic oligonucleotide
accgccagaauccaugggg

SEQ ID NO: 189 - RNA, 19 nt, Artificial Sequence
  Description of Artificial Sequence: Synthetic oligonucleotide
auauccuguugggcauucu

SEQ ID NO: 190 - RNA, 19 nt, Artificial Sequence
  Description of Artificial Sequence: Synthetic oligonucleotide
agaaugcccaacaggauau

SEQ ID NO: 191 - RNA, 19 nt, Artificial Sequence
  Description of Artificial Sequence: Synthetic oligonucleotide
agucauguucuucaaaugc

SEQ ID NO: 192 - RNA, 19 nt, Artificial Sequence
  Description of Artificial Sequence: Synthetic oligonucleotide
gcauuugaagaacaugacu

SEQ ID NO: 193 - RNA, 19 nt, Artificial Sequence
  Description of Artificial Sequence: Synthetic oligonucleotide
guagugaaaaucgaggaag

SEQ ID NO: 194 - RNA, 19 nt, Artificial Sequence
  Description of Artificial Sequence: Synthetic oligonucleotide
cuuccucgauuuucacuac

SEQ ID NO: 195 - RNA, 19 nt, Artificial Sequence
  Description of Artificial Sequence: Synthetic oligonucleotide
gaucacccugaauucauug

SEQ ID NO: 196 - RNA, 19 nt, Artificial Sequence
  Description of Artificial Sequence: Synthetic oligonucleotide
caaugaauucagggugauc

SEQ ID NO: 197 - RNA, 19 nt, Artificial Sequence
  Description of Artificial Sequence: Synthetic oligonucleotide
aucacccugaauucauugu

SEQ ID NO: 198 - RNA, 19 nt, Artificial Sequence
  Description of Artificial Sequence: Synthetic oligonucleotide
acaaugaauucagggugau

SEQ ID NO: 199 - RNA, 19 nt, Artificial Sequence
  Description of Artificial Sequence: Synthetic oligonucleotide
aaugaacuaauucguuuug

SEQ ID NO: 200 - RNA, 19 nt, Artificial Sequence
  Description of Artificial Sequence: Synthetic oligonucleotide
caaaacgaauuaguucauu

SEQ ID NO: 201 - RNA, 19 nt, Artificial Sequence
  Description of Artificial Sequence: Synthetic oligonucleotide
auuagugucuaaggaauga

SEQ ID NO: 202 - RNA, 19 nt, Artificial Sequence
  Description of Artificial Sequence: Synthetic oligonucleotide
ucauuccuuagacacuaau

SEQ ID NO: 203 - RNA, 19 nt, Artificial Sequence
  Description of Artificial Sequence: Synthetic oligonucleotide
cuaauucguuuugaccaca

SEQ ID NO: 204 - RNA, 19 nt, Artificial Sequence
  Description of Artificial Sequence: Synthetic oligonucleotide
uguggucaaaacgaauuag

SEQ ID NO: 205 - RNA, 19 nt, Artificial Sequence
  Description of Artificial Sequence: Synthetic oligonucleotide
uucguuuugaccacauaua

SEQ ID NO: 206 - RNA, 19 nt, Artificial Sequence
  Description of Artificial Sequence: Synthetic oligonucleotide
uauauguggucaaaacgaa

SEQ ID NO: 207 - RNA, 19 nt, Artificial Sequence
  Description of Artificial Sequence: Synthetic oligonucleotide
cuuagagauacccucugag

SEQ ID NO: 208 - RNA, 19 nt, Artificial Sequence
  Description of Artificial Sequence: Synthetic oligonucleotide
cucagaggguaucucuaag

SEQ ID NO: 209 - RNA, 19 nt, Artificial Sequence
  Description of Artificial Sequence: Synthetic oligonucleotide
acugccuggaggauagcag

SEQ ID NO: 210 - RNA, 19 nt, Artificial Sequence
  Description of Artificial Sequence: Synthetic oligonucleotide
cugcuauccuccaggcagu

SEQ ID NO: 211 - RNA, 19 nt, Artificial Sequence
  Description of Artificial Sequence: Synthetic oligonucleotide
auuguacuuuuaucuuaaa

SEQ ID NO: 212 - RNA, 19 nt, Artificial Sequence
  Description of Artificial Sequence: Synthetic oligonucleotide
uuuaagauaaaaguacaau

SEQ ID NO: 213 - RNA, 19 nt, Artificial Sequence
  Description of Artificial Sequence: Synthetic oligonucleotide
cauuagacaaaugucuuga

SEQ ID NO: 214 - RNA, 19 nt, Artificial Sequence
  Description of Artificial Sequence: Synthetic oligonucleotide
ucaagacauuugucuaaug

SEQ ID NO: 215 - RNA, 19 nt, Artificial Sequence
  Description of Artificial Sequence: Synthetic oligonucleotide
uaugaaugguucuuuauca

SEQ ID NO: 216 - RNA, 19 nt, Artificial Sequence
  Description of Artificial Sequence: Synthetic oligonucleotide
ugauaaagaaccauucaua

SEQ ID NO: 217 - RNA, 19 nt, Artificial Sequence
  Description of Artificial Sequence: Synthetic oligonucleotide
aaacuacccaugcaauuaa

SEQ ID NO: 218 - RNA, 19 nt, Artificial Sequence
  Description of Artificial Sequence: Synthetic oligonucleotide
uuaauugcauggguaguuu

SEQ ID NO: 219 - RNA, 19 nt, Artificial Sequence
  Description of Artificial Sequence: Synthetic oligonucleotide
gcucgaaugagugagcugg

SEQ ID NO: 220 - RNA, 19 nt, Artificial Sequence
  Description of Artificial Sequence: Synthetic oligonucleotide
ccagcucacucauucgagc

SEQ ID NO: 221 - RNA, 19 nt, Artificial Sequence
  Description of Artificial Sequence: Synthetic oligonucleotide
aaaucagcuuuuacgagag

SEQ ID NO: 222 - RNA, 19 nt, Artificial Sequence
  Description of Artificial Sequence: Synthetic oligonucleotide
cucucguaaaagcugauuu

SEQ ID NO: 223 - RNA, 19 nt, Artificial Sequence
  Description of Artificial Sequence: Synthetic oligonucleotide
gucaguggggacgucauca

SEQ ID NO: 224 - RNA, 19 nt, Artificial Sequence
  Description of Artificial Sequence: Synthetic oligonucleotide
ugaugacguccccacugac

SEQ ID NO: 225 - RNA, 19 nt, Artificial Sequence
  Description of Artificial Sequence: Synthetic oligonucleotide
cauuaaugaacuaauucgu

SEQ ID NO: 226 - RNA, 19 nt, Artificial Sequence
  Description of Artificial Sequence: Synthetic oligonucleotide
acgaauuaguucauuaaug

SEQ ID NO: 227 - RNA, 19 nt, Artificial Sequence
  Description of Artificial Sequence: Synthetic oligonucleotide
uuagacaaaugucuugaag

SEQ ID NO: 228 - RNA, 19 nt, Artificial Sequence
  Description of Artificial Sequence: Synthetic oligonucleotide
cuucaagacauuugucuaa

SEQ ID NO: 229 - RNA, 19 nt, Artificial Sequence
  Description of Artificial Sequence: Synthetic oligonucleotide
caugcaauuaaaagguaca

SEQ ID NO: 230 - RNA, 19 nt, Artificial Sequence
  Description of Artificial Sequence: Synthetic oligonucleotide
uguaccuuuuaauugcaug

SEQ ID NO: 231 - RNA, 19 nt, Artificial Sequence
  Description of Artificial Sequence: Synthetic oligonucleotide
aauucguuuugaccacaua

SEQ ID NO: 232 - RNA, 19 nt, Artificial Sequence
  Description of Artificial Sequence: Synthetic oligonucleotide
uauguggucaaaacgaauu

SEQ ID NO: 233 - RNA, 19 nt, Artificial Sequence
  Description of Artificial Sequence: Synthetic oligonucleotide
ggucauuagacaaaugucu

SEQ ID NO: 234 - RNA, 19 nt, Artificial Sequence
  Description of Artificial Sequence: Synthetic oligonucleotide
agacauuugucuaaugacc

SEQ ID NO: 235 - RNA, 19 nt, Artificial Sequence
  Description of Artificial Sequence: Synthetic oligonucleotide
aauuaaaagguacaaugca

SEQ ID NO: 236 - RNA, 19 nt, Artificial Sequence
  Description of Artificial Sequence: Synthetic oligonucleotide
ugcauuguaccuuuuaauu

SEQ ID NO: 237 - RNA, 19 nt, Artificial Sequence
  Description of Artificial Sequence: Synthetic oligonucleotide
gaaaaucagcuuuuacgag

SEQ ID NO: 238 - RNA, 19 nt, Artificial Sequence
  Description of Artificial Sequence: Synthetic oligonucleotide
cucguaaaagcugauuuuc

SEQ ID NO: 239 - RNA, 19 nt, Artificial Sequence
  Description of Artificial Sequence: Synthetic oligonucleotide
gaccacauauauaccaagc

SEQ ID NO: 240 - RNA, 19 nt, Artificial Sequence
  Description of Artificial Sequence: Synthetic oligonucleotide
gcuugguauauaugugguc

SEQ ID NO: 241 - RNA, 19 nt, Artificial Sequence
  Description of Artificial Sequence: Synthetic oligonucleotide
gggucauuagacaaauguc

SEQ ID NO: 242 - RNA, 19 nt, Artificial Sequence
  Description of Artificial Sequence: Synthetic oligonucleotide
gacauuugucuaaugaccc

SEQ ID NO: 243 - RNA, 19 nt, Artificial Sequence
  Description of Artificial Sequence: Synthetic oligonucleotide
uguagcuucugaaaggugc

SEQ ID NO: 244 - RNA, 19 nt, Artificial Sequence
  Description of Artificial Sequence: Synthetic oligonucleotide
gcaccuuucagaagcuaca

SEQ ID NO: 245 - RNA, 19 nt, Artificial Sequence
  Description of Artificial Sequence: Synthetic oligonucleotide
guugagaaccaggaguuaa

SEQ ID NO: 246 - RNA, 19 nt, Artificial Sequence
  Description of Artificial Sequence: Synthetic oligonucleotide
uuaacuccugguucucaac

SEQ ID NO: 247 - RNA, 19 nt, Artificial Sequence
  Description of Artificial Sequence: Synthetic oligonucleotide
accaggaguuaagacagcg

SEQ ID NO: 248 - RNA, 19 nt, Artificial Sequence
  Description of Artificial Sequence: Synthetic oligonucleotide
cgcugucuuaacuccuggu

SEQ ID NO: 249 - RNA, 19 nt, Artificial Sequence
  Description of Artificial Sequence: Synthetic oligonucleotide
ucuuaaaagggugguaguu

SEQ ID NO: 250 - RNA, 19 nt, Artificial Sequence
  Description of Artificial Sequence: Synthetic oligonucleotide
aacuaccacccuuuuaaga

SEQ ID NO: 251 - RNA, 19 nt, Artificial Sequence
  Description of Artificial Sequence: Synthetic oligonucleotide
uuuuccugcuaguguagcu

SEQ ID NO: 252 - RNA, 19 nt, Artificial Sequence
  Description of Artificial Sequence: Synthetic oligonucleotide
agcuacacuagcaggaaaa

SEQ ID NO: 253 - RNA, 19 nt, Artificial Sequence
  Description of Artificial Sequence: Synthetic oligonucleotide
ccaggaguuaagacagcgc

SEQ ID NO: 254 - RNA, 19 nt, Artificial Sequence
  Description of Artificial Sequence: Synthetic oligonucleotide
gcgcugucuuaacuccugg

SEQ ID NO: 255 - RNA, 19 nt, Artificial Sequence
  Description of Artificial Sequence: Synthetic oligonucleotide
cuuccugccuacuggaugc

SEQ ID NO: 256 - RNA, 19 nt, Artificial Sequence
  Description of Artificial Sequence: Synthetic oligonucleotide
gcauccaguaggcaggaag

SEQ ID NO: 257 - RNA, 19 nt, Artificial Sequence
  Description of Artificial Sequence: Synthetic oligonucleotide
ccuacuggaugcuuacagu

SEQ ID NO: 258 - RNA, 19 nt, Artificial Sequence
  Description of Artificial Sequence: Synthetic oligonucleotide
acuguaagcauccaguagg

SEQ ID NO: 259 - RNA, 19 nt, Artificial Sequence
  Description of Artificial Sequence: Synthetic oligonucleotide
agugucuaaggaaugaucc

SEQ ID NO: 260 - RNA, 19 nt, Artificial Sequence
  Description of Artificial Sequence: Synthetic oligonucleotide
ggaucauuccuuagacacu

SEQ ID NO: 261 - RNA, 19 nt, Artificial Sequence
  Description of Artificial Sequence: Synthetic oligonucleotide
gugucuaaggaaugaucca

SEQ ID NO: 262 - RNA, 19 nt, Artificial Sequence
  Description of Artificial Sequence: Synthetic oligonucleotide
uggaucauuccuuagacac

SEQ ID NO: 263 - RNA, 19 nt, Artificial Sequence
  Description of Artificial Sequence: Synthetic oligonucleotide
uacuauaauugagaacuac

SEQ ID NO: 264 - RNA, 19 nt, Artificial Sequence
  Description of Artificial Sequence: Synthetic oligonucleotide
guaguucucaauuauagua

SEQ ID NO: 265 - RNA, 19 nt, Artificial Sequence
  Description of Artificial Sequence: Synthetic oligonucleotide
aucuuaaaagggugguagu

SEQ ID NO: 266 - RNA, 19 nt, Artificial Sequence
  Description of Artificial Sequence: Synthetic oligonucleotide
acuaccacccuuuuaagau

SEQ ID NO: 267 - RNA, 19 nt, Artificial Sequence
  Description of Artificial Sequence: Synthetic oligonucleotide
auucuggcgguauugacuc

SEQ ID NO: 268 - RNA, 19 nt, Artificial Sequence
  Description of Artificial Sequence: Synthetic oligonucleotide
gagucaauaccgccagaau

SEQ ID NO: 269 - RNA, 19 nt, Artificial Sequence
  Description of Artificial Sequence: Synthetic oligonucleotide
gacccaguuccuuaccagc

SEQ ID NO: 270 - RNA, 19 nt, Artificial Sequence
  Description of Artificial Sequence: Synthetic oligonucleotide
gcugguaaggaacuggguc

SEQ ID NO: 271 - RNA, 19 nt, Artificial Sequence
  Description of Artificial Sequence: Synthetic oligonucleotide
ucugucaguggggacguca

SEQ ID NO: 272 - RNA, 19 nt, Artificial Sequence
  Description of Artificial Sequence: Synthetic oligonucleotide
ugacguccccacugacaga

SEQ ID NO: 273 - RNA, 19 nt, Artificial Sequence
  Description of Artificial Sequence: Synthetic oligonucleotide
gccauuaaugaacuaauuc

SEQ ID NO: 274 - RNA, 19 nt, Artificial Sequence
  Description of Artificial Sequence: Synthetic oligonucleotide
gaauuaguucauuaauggc

SEQ ID NO: 275 - RNA, 19 nt, Artificial Sequence
  Description of Artificial Sequence: Synthetic oligonucleotide
ugaccacauauauaccaag

SEQ ID NO: 276 - RNA, 19 nt, Artificial Sequence
  Description of Artificial Sequence: Synthetic oligonucleotide
cuugguauauaugugguca

SEQ ID NO: 277 - RNA, 19 nt, Artificial Sequence
  Description of Artificial Sequence: Synthetic oligonucleotide
ccacauauauaccaagccc

SEQ ID NO: 278 - RNA, 19 nt, Artificial Sequence
  Description of Artificial Sequence: Synthetic oligonucleotide
gggcuugguauauaugugg

SEQ ID NO: 279 - RNA, 19 nt, Artificial Sequence
  Description of Artificial Sequence: Synthetic oligonucleotide
gcuggguaucucaaaucug

SEQ ID NO: 280 - RNA, 19 nt, Artificial Sequence
  Description of Artificial Sequence: Synthetic oligonucleotide
cagauuugagauacccagc

SEQ ID NO: 281 - RNA, 19 nt, Artificial Sequence
  Description of Artificial Sequence: Synthetic oligonucleotide
auugagaacuacagcuuuu

SEQ ID NO: 282 - RNA, 19 nt, Artificial Sequence
  Description of Artificial Sequence: Synthetic oligonucleotide
aaaagcuguaguucucaau

SEQ ID NO: 283 - RNA, 19 nt, Artificial Sequence
  Description of Artificial Sequence: Synthetic oligonucleotide
uacuucaaguaagaucaag

SEQ ID NO: 284 - RNA, 19 nt, Artificial Sequence
  Description of Artificial Sequence: Synthetic oligonucleotide
cuugaucuuacuugaagua

SEQ ID NO: 285 - RNA, 19 nt, Artificial Sequence
  Description of Artificial Sequence: Synthetic oligonucleotide
aaaaacagaguagcagcuc

SEQ ID NO: 286 - RNA, 19 nt, Artificial Sequence
  Description of Artificial Sequence: Synthetic oligonucleotide
gagcugcuacucuguuuuu

SEQ ID NO: 287 - RNA, 19 nt, Artificial Sequence
  Description of Artificial Sequence: Synthetic oligonucleotide
guuuugaccacauauauac

SEQ ID NO: 288 - RNA, 19 nt, Artificial Sequence
  Description of Artificial Sequence: Synthetic oligonucleotide
guauauauguggucaaaac

SEQ ID NO: 289 - RNA, 19 nt, Artificial Sequence
  Description of Artificial Sequence: Synthetic oligonucleotide
acugaaaaacagaguagca

SEQ ID NO: 290 - RNA, 19 nt, Artificial Sequence
  Description of Artificial Sequence: Synthetic oligonucleotide
ugcuacucuguuuuucagu

SEQ ID NO: 291 - RNA, 19 nt, Artificial Sequence
  Description of Artificial Sequence: Synthetic oligonucleotide
ucuucagauucagagucug

SEQ ID NO: 292 - RNA, 19 nt, Artificial Sequence
  Description of Artificial Sequence: Synthetic oligonucleotide
cagacucugaaucugaaga

SEQ ID NO: 293 - RNA, 19 nt, Artificial Sequence
  Description of Artificial Sequence: Synthetic oligonucleotide
caaaucugcuuucauccag

SEQ ID NO: 294 - RNA, 19 nt, Artificial Sequence
  Description of Artificial Sequence: Synthetic oligonucleotide
cuggaugaaagcagauuug

SEQ ID NO: 295 - RNA, 19 nt, Artificial Sequence
  Description of Artificial Sequence: Synthetic oligonucleotide
accauucuugggaggacac

SEQ ID NO: 296 - RNA, 19 nt, Artificial Sequence
  Description of Artificial Sequence: Synthetic oligonucleotide
guguccucccaagaauggu

SEQ ID NO: 297 - RNA, 19 nt, Artificial Sequence
  Description of Artificial Sequence: Synthetic oligonucleotide
uugggaggacacuuuugcc

SEQ ID NO: 298 - RNA, 19 nt, Artificial Sequence
  Description of Artificial Sequence: Synthetic oligonucleotide
ggcaaaaguguccucccaa

SEQ ID NO: 299 - RNA, 19 nt, Artificial Sequence
  Description of Artificial Sequence: Synthetic oligonucleotide
cagcugauuagugucuaag

SEQ ID NO: 300 - RNA, 19 nt, Artificial Sequence
  Description of Artificial Sequence: Synthetic oligonucleotide
cuuagacacuaaucagcug

SEQ ID NO: 301 - RNA, 19 nt, Artificial Sequence
  Description of Artificial Sequence: Synthetic oligonucleotide
ugauuagugucuaaggaau

SEQ ID NO: 302 - RNA, 19 nt, Artificial Sequence
  Description of Artificial Sequence: Synthetic oligonucleotide
auuccuuagacacuaauca

SEQ ID NO: 303 - RNA, 19 nt, Artificial Sequence
  Description of Artificial Sequence: Synthetic oligonucleotide
uuagugucuaaggaaugau

SEQ ID NO: 304 - RNA, 19 nt, Artificial Sequence
  Description of Artificial Sequence: Synthetic oligonucleotide
aucauuccuuagacacuaa

SEQ ID NO: 305 - RNA, 19 nt, Artificial Sequence
  Description of Artificial Sequence: Synthetic oligonucleotide
acuauuacacugccuggag

SEQ ID NO: 306 - RNA, 19 nt, Artificial Sequence
  Description of Artificial Sequence: Synthetic oligonucleotide
cuccaggcaguguaauagu

SEQ ID NO: 307 - RNA, 19 nt, Artificial Sequence
  Description of Artificial Sequence: Synthetic oligonucleotide
ugaaugguucuuuaucauu

SEQ ID NO: 308 - RNA, 19 nt, Artificial Sequence
  Description of Artificial Sequence: Synthetic oligonucleotide
aaugauaaagaaccauuca

SEQ ID NO: 309 - RNA, 19 nt, Artificial Sequence
  Description of Artificial Sequence: Synthetic oligonucleotide
gaaugguucuuuaucauuu

SEQ ID NO: 310 - RNA, 19 nt, Artificial Sequence
  Description of Artificial Sequence: Synthetic oligonucleotide
aaaugauaaagaaccauuc

SEQ ID NO: 311 - RNA, 19 nt, Artificial Sequence
  Description of Artificial Sequence: Synthetic oligonucleotide
ucaaguaagaucaagaauc

SEQ ID NO: 312 - RNA, 19 nt, Artificial Sequence
  Description of Artificial Sequence: Synthetic oligonucleotide
gauucuugaucuuacuuga

SEQ ID NO: 313 - RNA, 19 nt, Artificial Sequence
  Description of Artificial Sequence: Synthetic oligonucleotide
uauagaaauuuacuaugua

SEQ ID NO: 314 - RNA, 19 nt, Artificial Sequence
  Description of Artificial Sequence: Synthetic oligonucleotide
uacauaguaaauuucuaua

SEQ ID NO: 315 - RNA, 19 nt, Artificial Sequence
  Description of Artificial Sequence: Synthetic oligonucleotide
aauuuacuauguaaaugcu

SEQ ID NO: 316 - RNA, 19 nt, Artificial Sequence
  Description of Artificial Sequence: Synthetic oligonucleotide
agcauuuacauaguaaauu

SEQ ID NO: 317 - RNA, 19 nt, Artificial Sequence
  Description of Artificial Sequence: Synthetic oligonucleotide
uuaaaacuacccaugcaau

SEQ ID NO: 318 - RNA, 19 nt, Artificial Sequence
  Description of Artificial Sequence: Synthetic oligonucleotide
auugcauggguaguuuuaa

SEQ ID NO: 319 - RNA, 19 nt, Artificial Sequence
  Description of Artificial Sequence: Synthetic oligonucleotide
gcugccccaggcgcgcaag

SEQ ID NO: 320 - RNA, 19 nt, Artificial Sequence
  Description of Artificial Sequence: Synthetic oligonucleotide
cuugcgcgccuggggcagc

SEQ ID NO: 321 - RNA, 19 nt, Artificial Sequence
  Description of Artificial Sequence: Synthetic oligonucleotide
aacugaaaaacagaguagc

SEQ ID NO: 322 - RNA, 19 nt, Artificial Sequence
  Description of Artificial Sequence: Synthetic oligonucleotide
gcuacucuguuuuucaguu

SEQ ID NO: 323 - RNA, 19 nt, Artificial Sequence
  Description of Artificial Sequence: Synthetic oligonucleotide
aaaacagaguagcagcuca

SEQ ID NO: 324 - RNA, 19 nt, Artificial Sequence
  Description of Artificial Sequence: Synthetic oligonucleotide
ugagcugcuacucuguuuu

SEQ ID NO: 325 - RNA, 19 nt, Artificial Sequence
  Description of Artificial Sequence: Synthetic oligonucleotide
gaguagcagcucagacugc

SEQ ID NO: 326 - RNA, 19 nt, Artificial Sequence
  Description of Artificial Sequence: Synthetic oligonucleotide
gcagucugagcugcuacuc

SEQ ID NO: 327 - RNA, 19 nt, Artificial Sequence
  Description of Artificial Sequence: Synthetic oligonucleotide
ggaacagcaagugguagau

SEQ ID NO: 328 - RNA, 19 nt, Artificial Sequence
  Description of Artificial Sequence: Synthetic oligonucleotide
aucuaccacuugcuguucc

SEQ ID NO: 329 - RNA, 19 nt, Artificial Sequence
  Description of Artificial Sequence: Synthetic oligonucleotide
uugagaaccaggaguuaag

SEQ ID NO: 330 - RNA, 19 nt, Artificial Sequence
  Description of Artificial Sequence: Synthetic oligonucleotide
cuuaacuccugguucucaa

SEQ ID NO: 331 - RNA, 19 nt, Artificial Sequence
  Description of Artificial Sequence: Synthetic oligonucleotide
gcaggcccaguugucaccc

SEQ ID NO: 332 - RNA, 19 nt, Artificial Sequence
  Description of Artificial Sequence: Synthetic oligonucleotide
gggugacaacugggccugc

SEQ ID NO: 333 - RNA, 19 nt, Artificial Sequence
  Description of Artificial Sequence: Synthetic oligonucleotide
acaucuccccauggauucu

SEQ ID NO: 334 - RNA, 19 nt, Artificial Sequence
  Description of Artificial Sequence: Synthetic oligonucleotide
agaauccauggggagaugu

SEQ ID NO: 335 - RNA, 19 nt, Artificial Sequence
  Description of Artificial Sequence: Synthetic oligonucleotide
ucuggcgguauugacucuu

SEQ ID NO: 336 - RNA, 19 nt, Artificial Sequence
  Description of Artificial Sequence: Synthetic oligonucleotide
aagagucaauaccgccaga

SEQ ID NO: 337 - RNA, 19 nt, Artificial Sequence
  Description of Artificial Sequence: Synthetic oligonucleotide
uuggacccagucauguucu

SEQ ID NO: 338 - RNA, 19 nt, Artificial Sequence
  Description of Artificial Sequence: Synthetic oligonucleotide
agaacaugacuggguccaa

SEQ ID NO: 339 - RNA, 19 nt, Artificial Sequence
  Description of Artificial Sequence: Synthetic oligonucleotide
ggacgucaucagccaagcu

SEQ ID NO: 340 - RNA, 19 nt, Artificial Sequence
  Description of Artificial Sequence: Synthetic oligonucleotide
agcuuggcugaugacgucc

SEQ ID NO: 341 - RNA, 19 nt, Artificial Sequence
  Description of Artificial Sequence: Synthetic oligonucleotide
ccucagagaaugaucaccc

SEQ ID NO: 342 - RNA, 19 nt, Artificial Sequence
  Description of Artificial Sequence: Synthetic oligonucleotide
gggugaucauucucugagg

SEQ ID NO: 343 - RNA, 19 nt, Artificial Sequence
  Description of Artificial Sequence: Synthetic oligonucleotide
cacccugaauucauugucu

SEQ ID NO: 344 - RNA, 19 nt, Artificial Sequence
  Description of Artificial Sequence: Synthetic oligonucleotide
agacaaugaauucagggug

SEQ ID NO: 345 - RNA, 19 nt, Artificial Sequence
  Description of Artificial Sequence: Synthetic oligonucleotide
gaaggaagaaccuguagaa

SEQ ID NO: 346 - RNA, 19 nt, Artificial Sequence
  Description of Artificial Sequence: Synthetic oligonucleotide
uucuacagguucuuccuuc

SEQ ID NO: 347 - RNA, 19 nt, Artificial Sequence
  Description of Artificial Sequence: Synthetic oligonucleotide
guaucucaaaucugcuuuc

SEQ ID NO: 348 - RNA, 19 nt, Artificial Sequence
  Description of Artificial Sequence: Synthetic oligonucleotide
gaaagcagauuugagauac

SEQ ID NO: 349 - RNA, 19 nt, Artificial Sequence
  Description of Artificial Sequence: Synthetic oligonucleotide
aaucugcuuucauccagcc

SEQ ID NO: 350 - RNA, 19 nt, Artificial Sequence
  Description of Artificial Sequence: Synthetic oligonucleotide
ggcuggaugaaagcagauu

SEQ ID NO: 351 - RNA, 19 nt, Artificial Sequence
  Description of Artificial Sequence: Synthetic oligonucleotide
uugguguaaaccauucuug

SEQ ID NO: 352 - RNA, 19 nt, Artificial Sequence
  Description of Artificial Sequence: Synthetic oligonucleotide
caagaaugguuuacaccaa

SEQ ID NO: 353 - RNA, 19 nt, Artificial Sequence
  Description of Artificial Sequence: Synthetic oligonucleotide
guguaaaccauucuuggga

SEQ ID NO: 354 - RNA, 19 nt, Artificial Sequence
  Description of Artificial Sequence: Synthetic oligonucleotide
ucccaagaaugguuuacac

SEQ ID NO: 355 - RNA, 19 nt, Artificial Sequence
  Description of Artificial Sequence: Synthetic oligonucleotide
uguaaaccauucuugggag

SEQ ID NO: 356 - RNA, 19 nt, Artificial Sequence
  Description of Artificial Sequence: Synthetic oligonucleotide
cucccaagaaugguuuaca

SEQ ID NO: 357 - RNA, 19 nt, Artificial Sequence
  Description of Artificial Sequence: Synthetic oligonucleotide
ugggaggacacuuuugcca

SEQ ID NO: 358 - RNA, 19 nt, Artificial Sequence
  Description of Artificial Sequence: Synthetic oligonucleotide
uggcaaaaguguccuccca

SEQ ID NO: 359 - RNA, 19 nt, Artificial Sequence
  Description of Artificial Sequence: Synthetic oligonucleotide
gaggacacuuuugccaaug

SEQ ID NO: 360 - RNA, 19 nt, Artificial Sequence
  Description of Artificial Sequence: Synthetic oligonucleotide
cauuggcaaaaguguccuc

SEQ ID NO: 361 - RNA, 19 nt, Artificial Sequence
  Description of Artificial Sequence: Synthetic oligonucleotide
gauuagugucuaaggaaug

SEQ ID NO: 362 - RNA, 19 nt, Artificial Sequence
  Description of Artificial Sequence: Synthetic oligonucleotide
cauuccuuagacacuaauc

SEQ ID NO: 363 - RNA, 19 nt, Artificial Sequence
  Description of Artificial Sequence: Synthetic oligonucleotide
uagugucuaaggaaugauc

SEQ ID NO: 364 - RNA, 19 nt, Artificial Sequence
  Description of Artificial Sequence: Synthetic oligonucleotide
gaucauuccuuagacacua

SEQ ID NO: 365 - RNA, 19 nt, Artificial Sequence
  Description of Artificial Sequence: Synthetic oligonucleotide
acuguugcccuuuuccuug

SEQ ID NO: 366 - RNA, 19 nt, Artificial Sequence
  Description of Artificial Sequence: Synthetic oligonucleotide
caaggaaaagggcaacagu

SEQ ID NO: 367 - RNA, 19 nt, Artificial Sequence
  Description of Artificial Sequence: Synthetic oligonucleotide
ugucggggcagcccgccuc

SEQ ID NO: 368 - RNA, 19 nt, Artificial Sequence
  Description of Artificial Sequence: Synthetic oligonucleotide
gaggcgggcugccccgaca

SEQ ID NO: 369 - RNA, 19 nt, Artificial Sequence
  Description of Artificial Sequence: Synthetic oligonucleotide
gucggggcagcccgccucc

SEQ ID NO: 370 - RNA, 19 nt, Artificial Sequence
  Description of Artificial Sequence: Synthetic oligonucleotide
ggaggcgggcugccccgac

SEQ ID NO: 371 - RNA, 19 nt, Artificial Sequence
  Description of Artificial Sequence: Synthetic oligonucleotide
uaagggucauuagacaaau

SEQ ID NO: 372 - RNA, 19 nt, Artificial Sequence
  Description of Artificial Sequence: Synthetic oligonucleotide
auuugucuaaugacccuua

SEQ ID NO: 373 - RNA, 19 nt, Artificial Sequence
  Description of Artificial Sequence: Synthetic oligonucleotide
ucucuucccccuuuuuggc

SEQ ID NO: 374 - RNA, 19 nt, Artificial Sequence
  Description of Artificial Sequence: Synthetic oligonucleotide
gccaaaaagggggaagaga

SEQ ID NO: 375 - RNA, 19 nt, Artificial Sequence
  Description of Artificial Sequence: Synthetic oligonucleotide
auacuucaaguaagaucaa

SEQ ID NO: 376 - RNA, 19 nt, Artificial Sequence
  Description of Artificial Sequence: Synthetic oligonucleotide
uugaucuuacuugaaguau

SEQ ID NO: 377 - RNA, 19 nt, Artificial Sequence
  Description of Artificial Sequence: Synthetic oligonucleotide
caaguaagaucaagaaucu

SEQ ID NO: 378 - RNA, 19 nt, Artificial Sequence
  Description of Artificial Sequence: Synthetic oligonucleotide
agauucuugaucuuacuug

SEQ ID NO: 379 - RNA, 19 nt, Artificial Sequence
  Description of Artificial Sequence: Synthetic oligonucleotide
ccauuuauuuaaaacuacc

SEQ ID NO: 380 - RNA, 19 nt, Artificial Sequence
  Description of Artificial Sequence: Synthetic oligonucleotide
gguaguuuuaaauaaaugg

SEQ ID NO: 381 - RNA, 19 nt, Artificial Sequence
  Description of Artificial Sequence: Synthetic oligonucleotide
cauuuauuuaaaacuaccc

SEQ ID NO: 382 - RNA, 19 nt, Artificial Sequence
  Description of Artificial Sequence: Synthetic oligonucleotide
ggguaguuuuaaauaaaug

SEQ ID NO: 383 - RNA, 19 nt, Artificial Sequence
  Description of Artificial Sequence: Synthetic oligonucleotide
cugaaaaacagaguagcag

SEQ ID NO: 384 - RNA, 19 nt, Artificial Sequence
  Description of Artificial Sequence: Synthetic oligonucleotide
cugcuacucuguuuuucag

SEQ ID NO: 385 - RNA, 19 nt, Artificial Sequence
  Description of Artificial Sequence: Synthetic oligonucleotide
gaaaaacagaguagcagcu

SEQ ID NO: 386 - RNA, 19 nt, Artificial Sequence
  Description of Artificial Sequence: Synthetic oligonucleotide
agcugcuacucuguuuuuc

SEQ ID NO: 387 - RNA, 19 nt, Artificial Sequence
  Description of Artificial Sequence: Synthetic oligonucleotide
cagaguagcagcucagacu

SEQ ID NO: 388 - RNA, 19 nt, Artificial Sequence
  Description of Artificial Sequence: Synthetic oligonucleotide
agucugagcugcuacucug

SEQ ID NO: 389 - RNA, 19 nt, Artificial Sequence
  Description of Artificial Sequence: Synthetic oligonucleotide
aguagcagcucagacugcc

SEQ ID NO: 390 - RNA, 19 nt, Artificial Sequence
  Description of Artificial Sequence: Synthetic oligonucleotide
ggcagucugagcugcuacu

SEQ ID NO: 391 - RNA, 19 nt, Artificial Sequence
  Description of Artificial Sequence: Synthetic oligonucleotide
agcaagugguagauuuaga

SEQ ID NO: 392 - RNA, 19 nt, Artificial Sequence
  Description of Artificial Sequence: Synthetic oligonucleotide
ucuaaaucuaccacuugcu

SEQ ID NO: 393 - RNA, 19 nt, Artificial Sequence
  Description of Artificial Sequence: Synthetic oligonucleotide
cagcuuuuacgagagaaaa

SEQ ID NO: 394 - RNA, 19 nt, Artificial Sequence
  Description of Artificial Sequence: Synthetic oligonucleotide
uuuucucucguaaaagcug

SEQ ID NO: 395 - RNA, 19 nt, Artificial Sequence
  Description of Artificial Sequence: Synthetic oligonucleotide
agcuuuuacgagagaaaac

SEQ ID NO: 396 - RNA, 19 nt, Artificial Sequence
  Description of Artificial Sequence: Synthetic oligonucleotide
guuuucucucguaaaagcu

SEQ ID NO: 397 - RNA, 19 nt, Artificial Sequence
  Description of Artificial Sequence: Synthetic oligonucleotide
gcuuuuacgagagaaaacu

SEQ ID NO: 398 - RNA, 19 nt, Artificial Sequence
  Description of Artificial Sequence: Synthetic oligonucleotide
aguuuucucucguaaaagc

SEQ ID NO: 399 - RNA, 19 nt, Artificial Sequence
  Description of Artificial Sequence: Synthetic oligonucleotide
ugaggccaguggccggguc

SEQ ID NO: 400 - RNA, 19 nt, Artificial Sequence
  Description of Artificial Sequence: Synthetic oligonucleotide
gacccggccacuggccuca

SEQ ID NO: 401 - RNA, 19 nt, Artificial Sequence
  Description of Artificial Sequence: Synthetic oligonucleotide
ccaguggccgggucugcug

SEQ ID NO: 402 - RNA, 19 nt, Artificial Sequence
  Description of Artificial Sequence: Synthetic oligonucleotide
cagcagacccggccacugg

SEQ ID NO: 403 - RNA, 19 nt, Artificial Sequence
  Description of Artificial Sequence: Synthetic oligonucleotide
uccagaacaucuccccaug

SEQ ID NO: 404 - RNA, 19 nt, Artificial Sequence
  Description of Artificial Sequence: Synthetic oligonucleotide
cauggggagauguucugga

SEQ ID NO: 405 - RNA, 19 nt, Artificial Sequence
  Description of Artificial Sequence: Synthetic oligonucleotide
cagaacaucuccccaugga

SEQ ID NO: 406 - RNA, 19 nt, Artificial Sequence
  Description of Artificial Sequence: Synthetic oligonucleotide
uccauggggagauguucug

SEQ ID NO: 407 - RNA, 19 nt, Artificial Sequence
  Description of Artificial Sequence: Synthetic oligonucleotide
aacaucuccccauggauuc

SEQ ID NO: 408 - RNA, 19 nt, Artificial Sequence
  Description of Artificial Sequence: Synthetic oligonucleotide
gaauccauggggagauguu

SEQ ID NO: 409 - RNA, 19 nt, Artificial Sequence
  Description of Artificial Sequence: Synthetic oligonucleotide
ucuccccauggauucuggc

SEQ ID NO: 410 - RNA, 19 nt, Artificial Sequence
  Description of Artificial Sequence: Synthetic oligonucleotide
gccagaauccauggggaga

SEQ ID NO: 411 - RNA, 19 nt, Artificial Sequence
  Description of Artificial Sequence: Synthetic oligonucleotide
ugggcauucuggacaacuu

SEQ ID NO: 412 - RNA, 19 nt, Artificial Sequence
  Description of Artificial Sequence: Synthetic oligonucleotide
aaguuguccagaaugccca

SEQ ID NO: 413 - RNA, 19 nt, Artificial Sequence
  Description of Artificial Sequence: Synthetic oligonucleotide
ucauguucuucaaaugccc

SEQ ID NO: 414 - RNA, 19 nt, Artificial Sequence
  Description of Artificial Sequence: Synthetic oligonucleotide
gggcauuugaagaacauga

SEQ ID NO: 415 - RNA, 19 nt, Artificial Sequence
  Description of Artificial Sequence: Synthetic oligonucleotide
uguucuucaaaugcccuuc

SEQ ID NO: 416 - RNA, 19 nt, Artificial Sequence
  Description of Artificial Sequence: Synthetic oligonucleotide
gaagggcauuugaagaaca

SEQ ID NO: 417 - RNA, 19 nt, Artificial Sequence
  Description of Artificial Sequence: Synthetic oligonucleotide
gaacuaauucguuuugacc

SEQ ID NO: 418 - RNA, 19 nt, Artificial Sequence
  Description of Artificial Sequence: Synthetic oligonucleotide
ggucaaaacgaauuaguuc

SEQ ID NO: 419 - RNA, 19 nt, Artificial Sequence
  Description of Artificial Sequence: Synthetic oligonucleotide
acuaauucguuuugaccac

SEQ ID NO: 420 - RNA, 19 nt, Artificial Sequence
  Description of Artificial Sequence: Synthetic oligonucleotide
guggucaaaacgaauuagu

SEQ ID NO: 421 - RNA, 19 nt, Artificial Sequence
  Description of Artificial Sequence: Synthetic oligonucleotide
auucguuuugaccacauau

SEQ ID NO: 422 - RNA, 19 nt, Artificial Sequence
  Description of Artificial Sequence: Synthetic oligonucleotide
auauguggucaaaacgaau

SEQ ID NO: 423 - RNA, 19 nt, Artificial Sequence
  Description of Artificial Sequence: Synthetic oligonucleotide
cacauauauaccaagcccc

SEQ ID NO: 424 - RNA, 19 nt, Artificial Sequence
  Description of Artificial Sequence: Synthetic oligonucleotide
ggggcuugguauauaugug

SEQ ID NO: 425 - RNA, 19 nt, Artificial Sequence
  Description of Artificial Sequence: Synthetic oligonucleotide
uuagagauacccucugaga

SEQ ID NO: 426 - RNA, 19 nt, Artificial Sequence
  Description of Artificial Sequence: Synthetic oligonucleotide
ucucagaggguaucucuaa

SEQ ID NO: 427 - RNA, 19 nt, Artificial Sequence
  Description of Artificial Sequence: Synthetic oligonucleotide
gagagccaagcuaaugugg

SEQ ID NO: 428 - RNA, 19 nt, Artificial Sequence
  Description of Artificial Sequence: Synthetic oligonucleotide
ccacauuagcuuggcucuc

SEQ ID NO: 429 - RNA, 19 nt, Artificial Sequence
  Description of Artificial Sequence: Synthetic oligonucleotide
gcuaaugugguagugaaaa

SEQ ID NO: 430 - RNA, 19 nt, Artificial Sequence
  Description of Artificial Sequence: Synthetic oligonucleotide
uuuucacuaccacauuagc

SEQ ID NO: 431 - RNA, 19 nt, Artificial Sequence
  Description of Artificial Sequence: Synthetic oligonucleotide
agugaaaaucgaggaagca

SEQ ID NO: 432 - RNA, 19 nt, Artificial Sequence
  Description of Artificial Sequence: Synthetic oligonucleotide
ugcuuccucgauuuucacu

SEQ ID NO: 433 - RNA, 19 nt, Artificial Sequence
  Description of Artificial Sequence: Synthetic oligonucleotide
gugaaaaucgaggaagcac

SEQ ID NO: 434 - RNA, 19 nt, Artificial Sequence
  Description of Artificial Sequence: Synthetic oligonucleotide
gugcuuccucgauuuucac

SEQ ID NO: 435 - RNA, 19 nt, Artificial Sequence
  Description of Artificial Sequence: Synthetic oligonucleotide
aggaagaaccuguagaaga

SEQ ID NO: 436 - RNA, 19 nt, Artificial Sequence
  Description of Artificial Sequence: Synthetic oligonucleotide
ucuucuacagguucuuccu

SEQ ID NO: 437 - RNA, 19 nt, Artificial Sequence
  Description of Artificial Sequence: Synthetic oligonucleotide
gucuuuugacauccagcag

SEQ ID NO: 438 - RNA, 19 nt, Artificial Sequence
  Description of Artificial Sequence: Synthetic oligonucleotide
cugcuggaugucaaaagac

SEQ ID NO: 439 - RNA, 19 nt, Artificial Sequence
  Description of Artificial Sequence: Synthetic oligonucleotide
ggcccugccgcucauggug

SEQ ID NO: 440 - RNA, 19 nt, Artificial Sequence
  Description of Artificial Sequence: Synthetic oligonucleotide
caccaugagcggcagggcc

SEQ ID NO: 441 - RNA, 19 nt, Artificial Sequence
  Description of Artificial Sequence: Synthetic oligonucleotide
aacuacagcuuuuaagauu

SEQ ID NO: 442 - RNA, 19 nt, Artificial Sequence
  Description of Artificial Sequence: Synthetic oligonucleotide
aaucuuaaaagcuguaguu

SEQ ID NO: 443 - RNA, 19 nt, Artificial Sequence
  Description of Artificial Sequence: Synthetic oligonucleotide
aagaggaggcggaagccaa

SEQ ID NO: 444 - DNA, 19 bp, Artificial Sequence
  Description of Combined DNA/RNA Molecule: Synthetic oligonucleotide
  Description of Artificial Sequence: Synthetic oligonucleotide
ttggcttccgcctcctctt

SEQ ID NO: 445 - RNA, 19 nt, Artificial Sequence
  Description of Artificial Sequence: Synthetic oligonucleotide
gcccaguugucaccccucc

SEQ ID NO: 446 - RNA, 19 nt, Artificial Sequence
  Description of Artificial Sequence: Synthetic oligonucleotide
ggaggggugacaacugggc

SEQ ID NO: 447 - RNA, 19 nt, Artificial Sequence
  Description of Artificial Sequence: Synthetic oligonucleotide
uggauucuggcgguauuga

SEQ ID NO: 448 - RNA, 19 nt, Artificial Sequence
  Description of Artificial Sequence: Synthetic oligonucleotide
ucaauaccgccagaaucca

SEQ ID NO: 449 - RNA, 19 nt, Artificial Sequence
  Description of Artificial Sequence: Synthetic oligonucleotide
ugccuacuggaugcuuaca

SEQ ID NO: 450 - RNA, 19 nt, Artificial Sequence
  Description of Artificial Sequence: Synthetic oligonucleotide
uguaagcauccaguaggca

SEQ ID NO: 451 - RNA, 19 nt, Artificial Sequence
  Description of Artificial Sequence: Synthetic oligonucleotide
ggauucuggcgguauugac

SEQ ID NO: 452 - RNA, 19 nt, Artificial Sequence
  Description of Artificial Sequence: Synthetic oligonucleotide
gucaauaccgccagaaucc

SEQ ID NO: 453 - RNA, 19 nt, Artificial Sequence
  Description of Artificial Sequence: Synthetic oligonucleotide
auucagagucugauauccu

SEQ ID NO: 454 - RNA, 19 nt, Artificial Sequence
  Description of Artificial Sequence: Synthetic oligonucleotide
aggauaucagacucugaau

SEQ ID NO: 455 - RNA, 19 nt, Artificial Sequence
  Description of Artificial Sequence: Synthetic oligonucleotide
cuggguaucucaaaucugc

SEQ ID NO: 456 - RNA, 19 nt, Artificial Sequence
  Description of Artificial Sequence: Synthetic oligonucleotide
gcagauuugagauacccag

SEQ ID NO: 457 - RNA, 19 nt, Artificial Sequence
  Description of Artificial Sequence: Synthetic oligonucleotide
uggguaucucaaaucugcu

SEQ ID NO: 458 - RNA, 19 nt, Artificial Sequence
  Description of Artificial Sequence: Synthetic oligonucleotide
agcagauuugagauaccca

SEQ ID NO: 459 - RNA, 19 nt, Artificial Sequence
  Description of Artificial Sequence: Synthetic oligonucleotide
aaccauucuugggaggaca

SEQ ID NO: 460 - RNA, 19 nt, Artificial Sequence
  Description of Artificial Sequence: Synthetic oligonucleotide
uguccucccaagaaugguu

SEQ ID NO: 461 - RNA, 19 nt, Artificial Sequence
  Description of Artificial Sequence: Synthetic oligonucleotide
uccuugacuauuacacugc

SEQ ID NO: 462 - RNA, 19 nt, Artificial Sequence
  Description of Artificial Sequence: Synthetic oligonucleotide
gcaguguaauagucaagga

SEQ ID NO: 463 - RNA, 19 nt, Artificial Sequence
  Description of Artificial Sequence: Synthetic oligonucleotide
cuugacuauuacacugccu

SEQ ID NO: 464 - RNA, 19 nt, Artificial Sequence
  Description of Artificial Sequence: Synthetic oligonucleotide
aggcaguguaauagucaag

SEQ ID NO: 465 - RNA, 19 nt, Artificial Sequence
  Description of Artificial Sequence: Synthetic oligonucleotide
gacuauuacacugccugga

SEQ ID NO: 466 - RNA, 19 nt, Artificial Sequence
  Description of Artificial Sequence: Synthetic oligonucleotide
uccaggcaguguaauaguc

SEQ ID NO: 467 - RNA, 19 nt, Artificial Sequence
  Description of Artificial Sequence: Synthetic oligonucleotide
agcuuuuaagauuguacuu

SEQ ID NO: 468 - RNA, 19 nt, Artificial Sequence
  Description of Artificial Sequence: Synthetic oligonucleotide
aaguacaaucuuaaaagcu

SEQ ID NO: 469 - RNA, 19 nt, Artificial Sequence
  Description of Artificial Sequence: Synthetic oligonucleotide
uuaucuuaaaaggguggua

SEQ ID NO: 470 - RNA, 19 nt, Artificial Sequence
  Description of Artificial Sequence: Synthetic oligonucleotide
uaccacccuuuuaagauaa

SEQ ID NO: 471 - RNA, 19 nt, Artificial Sequence
  Description of Artificial Sequence: Synthetic oligonucleotide
gucauuagacaaaugucuu

SEQ ID NO: 472 - RNA, 19 nt, Artificial Sequence
  Description of Artificial Sequence: Synthetic oligonucleotide
aagacauuugucuaaugac

SEQ ID NO: 473 - RNA, 19 nt, Artificial Sequence
  Description of Artificial Sequence: Synthetic oligonucleotide
ggcuugccuccaguuuuag

SEQ ID NO: 474 - RNA, 19 nt, Artificial Sequence
  Description of Artificial Sequence: Synthetic oligonucleotide
cuaaaacuggaggcaagcc

SEQ ID NO: 475 - RNA, 19 nt, Artificial Sequence
  Description of Artificial Sequence: Synthetic oligonucleotide
uuaguuugcuucuguaagc

SEQ ID NO: 476 - RNA, 19 nt, Artificial Sequence
  Description of Artificial Sequence: Synthetic oligonucleotide
gcuuacagaagcaaacuaa

SEQ ID NO: 477 - RNA, 19 nt, Artificial Sequence
  Description of Artificial Sequence: Synthetic oligonucleotide
uuacuauguaaaugcuuga

SEQ ID NO: 478 - RNA, 19 nt, Artificial Sequence
  Description of Artificial Sequence: Synthetic oligonucleotide
ucaagcauuuacauaguaa

SEQ ID NO: 479 - RNA, 19 nt, Artificial Sequence
  Description of Artificial Sequence: Synthetic oligonucleotide
acuauguaaaugcuugaug

SEQ ID NO: 480 - RNA, 19 nt, Artificial Sequence
  Description of Artificial Sequence: Synthetic oligonucleotide
caucaagcauuuacauagu

SEQ ID NO: 481 - RNA, 19 nt, Artificial Sequence
  Description of Artificial Sequence: Synthetic oligonucleotide
aaaugcuugauggaauuuu

SEQ ID NO: 482 - RNA, 19 nt, Artificial Sequence
  Description of Artificial Sequence: Synthetic oligonucleotide
aaaauuccaucaagcauuu

SEQ ID NO: 483 - RNA, 19 nt, Artificial Sequence
  Description of Artificial Sequence: Synthetic oligonucleotide
ugcuaguguagcuucugaa

SEQ ID NO: 484 - RNA, 19 nt, Artificial Sequence
  Description of Artificial Sequence: Synthetic oligonucleotide
uucagaagcuacacuagca

SEQ ID NO: 485 - RNA, 19 nt, Artificial Sequence
  Description of Artificial Sequence: Synthetic oligonucleotide
auuuauuuaaaacuaccca

SEQ ID NO: 486 - RNA, 19 nt, Artificial Sequence
  Description of Artificial Sequence: Synthetic oligonucleotide
uggguaguuuuaaauaaau

SEQ ID NO: 487 - RNA, 19 nt, Artificial Sequence
  Description of Artificial Sequence: Synthetic oligonucleotide
acccaugcaauuaaaaggu

SEQ ID NO: 488 - RNA, 19 nt, Artificial Sequence
  Description of Artificial Sequence: Synthetic oligonucleotide
accuuuuaauugcaugggu

SEQ ID NO: 489 - RNA, 19 nt, Artificial Sequence
  Description of Artificial Sequence: Synthetic oligonucleotide
gccgcucauggugccagcc

SEQ ID NO: 490 - RNA, 19 nt, Artificial Sequence
  Description of Artificial Sequence: Synthetic oligonucleotide
ggcuggcaccaugagcggc

SEQ ID NO: 491 - RNA, 19 nt, Artificial Sequence
  Description of Artificial Sequence: Synthetic oligonucleotide
cucagacugccagagaucg

SEQ ID NO: 492 - RNA, 19 nt, Artificial Sequence
  Description of Artificial Sequence: Synthetic oligonucleotide
cgaucucuggcagucugag

SEQ ID NO: 493 - RNA, 19 nt, Artificial Sequence
  Description of Artificial Sequence: Synthetic oligonucleotide
aacagcaagugguagauuu

SEQ ID NO: 494 - RNA, 19 nt, Artificial Sequence
  Description of Artificial Sequence: Synthetic oligonucleotide
aaaucuaccacuugcuguu

SEQ ID NO: 495 - RNA, 19 nt, Artificial Sequence
  Description of Artificial Sequence: Synthetic oligonucleotide
agaaccaaaaacuuuugcu

SEQ ID NO: 496 - RNA, 19 nt, Artificial Sequence
  Description of Artificial Sequence: Synthetic oligonucleotide
agcaaaaguuuuugguucu

SEQ ID NO: 497 - RNA, 19 nt, Artificial Sequence
  Description of Artificial Sequence: Synthetic oligonucleotide
aaccaaaaacuuuugcuag

SEQ ID NO: 498 - RNA, 19 nt, Artificial Sequence
  Description of Artificial Sequence: Synthetic oligonucleotide
cuagcaaaaguuuuugguu

SEQ ID NO: 499 - RNA, 19 nt, Artificial Sequence
  Description of Artificial Sequence: Synthetic oligonucleotide
ccgggucugcugaguccgc

SEQ ID NO: 500 - RNA, 19 nt, Artificial Sequence
  Description of Artificial Sequence: Synthetic oligonucleotide
gcggacucagcagacccgg

SEQ ID NO: 501 - RNA, 19 nt, Artificial Sequence
  Description of Artificial Sequence: Synthetic oligonucleotide
cgggucugcugaguccgca

SEQ ID NO: 502 - RNA, 19 nt, Artificial Sequence
  Description of Artificial Sequence: Synthetic oligonucleotide
ugcggacucagcagacccg

SEQ ID NO: 503 - RNA, 19 nt, Artificial Sequence
  Description of Artificial Sequence: Synthetic oligonucleotide
auggauucuggcgguauug

SEQ ID NO: 504 - RNA, 19 nt, Artificial Sequence
  Description of Artificial Sequence: Synthetic oligonucleotide
caauaccgccagaauccau

SEQ ID NO: 505 - RNA, 19 nt, Artificial Sequence
  Description of Artificial Sequence: Synthetic oligonucleotide
gauucuggcgguauugacu

SEQ ID NO: 506 - RNA, 19 nt, Artificial Sequence
  Description of Artificial Sequence: Synthetic oligonucleotide
agucaauaccgccagaauc

SEQ ID NO: 507 - RNA, 19 nt, Artificial Sequence
  Description of Artificial Sequence: Synthetic oligonucleotide
gagucugauauccuguugg

SEQ ID NO: 508 - RNA, 19 nt, Artificial Sequence
  Description of Artificial Sequence: Synthetic oligonucleotide
ccaacaggauaucagacuc

SEQ ID NO: 509 - RNA, 19 nt, Artificial Sequence
  Description of Artificial Sequence: Synthetic oligonucleotide
guggggacgucaucagcca

SEQ ID NO: 510 - RNA, 19 nt, Artificial Sequence
  Description of Artificial Sequence: Synthetic oligonucleotide
uggcugaugacguccccac

SEQ ID NO: 511 - RNA, 19 nt, Artificial Sequence
  Description of Artificial Sequence: Synthetic oligonucleotide
ugugguagugaaaaucgag

SEQ ID NO: 512 - RNA, 19 nt, Artificial Sequence
  Description of Artificial Sequence: Synthetic oligonucleotide
cucgauuuucacuaccaca

SEQ ID NO: 513 - RNA, 19 nt, Artificial Sequence
  Description of Artificial Sequence: Synthetic oligonucleotide
ugaaggaagaaccuguaga

SEQ ID NO: 514 - RNA, 19 nt, Artificial Sequence
  Description of Artificial Sequence: Synthetic oligonucleotide
ucuacagguucuuccuuca

SEQ ID NO: 515 - RNA, 19 nt, Artificial Sequence
  Description of Artificial Sequence: Synthetic oligonucleotide
acacugccuggaggauagc

SEQ ID NO: 516 - RNA, 19 nt, Artificial Sequence
  Description of Artificial Sequence: Synthetic oligonucleotide
gcuauccuccaggcagugu

SEQ ID NO: 517 - RNA, 19 nt, Artificial Sequence
  Description of Artificial Sequence: Synthetic oligonucleotide
acuacccaugcaauuaaaa

SEQ ID NO: 518 - RNA, 19 nt, Artificial Sequence
  Description of Artificial Sequence: Synthetic oligonucleotide
uuuuaauugcauggguagu

SEQ ID NO: 519 - RNA, 19 nt, Artificial Sequence
  Description of Artificial Sequence: Synthetic oligonucleotide
aggacccaguuccuuacca

SEQ ID NO: 520 - RNA, 19 nt, Artificial Sequence
  Description of Artificial Sequence: Synthetic oligonucleotide
ugguaaggaacuggguccu

SEQ ID NO: 521 - RNA, 19 nt, Artificial Sequence
  Description of Artificial Sequence: Synthetic oligonucleotide
cgucaucagccaagcugga

SEQ ID NO: 522 - RNA, 19 nt, Artificial Sequence
  Description of Artificial Sequence: Synthetic oligonucleotide
uccagcuuggcugaugacg

SEQ ID NO: 523 - RNA, 19 nt, Artificial Sequence
  Description of Artificial Sequence: Synthetic oligonucleotide
uaauucguuuugaccacau

SEQ ID NO: 524 - RNA, 19 nt, Artificial Sequence
  Description of Artificial Sequence: Synthetic oligonucleotide
auguggucaaaacgaauua

SEQ ID NO: 525 - RNA, 19 nt, Artificial Sequence
  Description of Artificial Sequence: Synthetic oligonucleotide
uuuugaccacauauauacc

SEQ ID NO: 526 - RNA, 19 nt, Artificial Sequence
  Description of Artificial Sequence: Synthetic oligonucleotide
gguauauauguggucaaaa

SEQ ID NO: 527 - RNA, 19 nt, Artificial Sequence
  Description of Artificial Sequence: Synthetic oligonucleotide
cugcuucugucggggcagc

SEQ ID NO: 528 - RNA, 19 nt, Artificial Sequence
  Description of Artificial Sequence: Synthetic oligonucleotide
gcugccccgacagaagcag

SEQ ID NO: 529 - RNA, 19 nt, Artificial Sequence
  Description of Artificial Sequence: Synthetic oligonucleotide
ugaaaaacagaguagcagc

SEQ ID NO: 530 - RNA, 19 nt, Artificial Sequence
  Description of Artificial Sequence: Synthetic oligonucleotide
gcugcuacucuguuuuuca

SEQ ID NO: 531 - RNA, 19 nt, Artificial Sequence
  Description of Artificial Sequence: Synthetic oligonucleotide
auuaaugaacuaauucguu

SEQ ID NO: 532 - RNA, 19 nt, Artificial Sequence
  Description of Artificial Sequence: Synthetic oligonucleotide
aacgaauuaguucauuaau

SEQ ID NO: 533 - RNA, 19 nt, Artificial Sequence
  Description of Artificial Sequence: Synthetic oligonucleotide
ucuugggaggacacuuuug

SEQ ID NO: 534 - RNA, 19 nt, Artificial Sequence
  Description of Artificial Sequence: Synthetic oligonucleotide
caaaaguguccucccaaga

SEQ ID NO: 535 - RNA, 19 nt, Artificial Sequence
  Description of Artificial Sequence: Synthetic oligonucleotide
cugauuagugucuaaggaa

SEQ ID NO: 536 - RNA, 19 nt, Artificial Sequence
  Description of Artificial Sequence: Synthetic oligonucleotide
uuccuuagacacuaaucag

SEQ ID NO: 537 - RNA, 19 nt, Artificial Sequence
  Description of Artificial Sequence: Synthetic oligonucleotide
gcccuuuuccuugacuauu

SEQ ID NO: 538 - RNA, 19 nt, Artificial Sequence
  Description of Artificial Sequence: Synthetic oligonucleotide
aauagucaaggaaaagggc

SEQ ID NO: 539 - RNA, 19 nt, Artificial Sequence
  Description of Artificial Sequence: Synthetic oligonucleotide
ccuuuuccuugacuauuac

SEQ ID NO: 540 - RNA, 19 nt, Artificial Sequence
  Description of Artificial Sequence: Synthetic oligonucleotide
guaauagucaaggaaaagg

SEQ ID NO: 541 - RNA, 19 nt, Artificial Sequence
  Description of Artificial Sequence: Synthetic oligonucleotide
cuauuacacugccuggagg

SEQ ID NO: 542 - RNA, 19 nt, Artificial Sequence
  Description of Artificial Sequence: Synthetic oligonucleotide
ccuccaggcaguguaauag

SEQ ID NO: 543 - RNA, 19 nt, Artificial Sequence
  Description of Artificial Sequence: Synthetic oligonucleotide
aauugagaacuacagcuuu

SEQ ID NO: 544 - RNA, 19 nt, Artificial Sequence
  Description of Artificial Sequence: Synthetic oligonucleotide
aaagcuguaguucucaauu

SEQ ID NO: 545 - RNA, 19 nt, Artificial Sequence
  Description of Artificial Sequence: Synthetic oligonucleotide
auuauguaagggucauuag

SEQ ID NO: 546 - RNA, 19 nt, Artificial Sequence
  Description of Artificial Sequence: Synthetic oligonucleotide
cuaaugacccuuacauaau

SEQ ID NO: 547 - RNA, 19 nt, Artificial Sequence
  Description of Artificial Sequence: Synthetic oligonucleotide
gguucuuuaucauuucucu

SEQ ID NO: 548 - RNA, 19 nt, Artificial Sequence
  Description of Artificial Sequence: Synthetic oligonucleotide
agagaaaugauaaagaacc

SEQ ID NO: 549 - RNA, 19 nt, Artificial Sequence
  Description of Artificial Sequence: Synthetic oligonucleotide
cauccuggcuugccuccag

SEQ ID NO: 550 - RNA, 19 nt, Artificial Sequence
  Description of Artificial Sequence: Synthetic oligonucleotide
cuggaggcaagccaggaug

SEQ ID NO: 551 - RNA, 19 nt, Artificial Sequence
  Description of Artificial Sequence: Synthetic oligonucleotide
gcuugccuccaguuuuagg

SEQ ID NO: 552 - RNA, 19 nt, Artificial Sequence
  Description of Artificial Sequence: Synthetic oligonucleotide
ccuaaaacuggaggcaagc

SEQ ID NO: 553 - RNA, 19 nt, Artificial Sequence
  Description of Artificial Sequence: Synthetic oligonucleotide
uuuccugcuaguguagcuu

SEQ ID NO: 554 - RNA, 19 nt, Artificial Sequence
  Description of Artificial Sequence: Synthetic oligonucleotide
aagcuacacuagcaggaaa

SEQ ID NO: 555 - RNA, 19 nt, Artificial Sequence
  Description of Artificial Sequence: Synthetic oligonucleotide
cugccgcucauggugccag

SEQ ID NO: 556 - RNA, 19 nt, Artificial Sequence
  Description of Artificial Sequence: Synthetic oligonucleotide
cuggcaccaugagcggcag

SEQ ID NO: 557 - RNA, 19 nt, Artificial Sequence
  Description of Artificial Sequence: Synthetic oligonucleotide
gaggcagcgagcggggggc

SEQ ID NO: 558 - DNA, 19 bp, Artificial Sequence
  Description of Combined DNA/RNA Molecule: Synthetic oligonucleotide
  Description of Artificial Sequence: Synthetic oligonucleotide
gccccccgctcgctgcctc

SEQ ID NO: 559 - RNA, 19 nt, Artificial Sequence
  Description of Artificial Sequence: Synthetic oligonucleotide
gcgagcggggggcugcccc

SEQ ID NO: 560 - RNA, 19 nt, Artificial Sequence
  Description of Artificial Sequence: Synthetic oligonucleotide
ggggcagccccccgcucgc

SEQ ID NO: 561 - RNA, 19 nt, Artificial Sequence
  Description of Artificial Sequence: Synthetic oligonucleotide
guagcagcucagacugcca

SEQ ID NO: 562 - RNA, 19 nt, Artificial Sequence
  Description of Artificial Sequence: Synthetic oligonucleotide
uggcagucugagcugcuac

SEQ ID NO: 563 - RNA, 19 nt, Artificial Sequence
  Description of Artificial Sequence: Synthetic oligonucleotide
uggaacagcaagugguaga

SEQ ID NO: 564 - RNA, 19 nt, Artificial Sequence
  Description of Artificial Sequence: Synthetic oligonucleotide
ucuaccacuugcuguucca

SEQ ID NO: 565 - RNA, 19 nt, Artificial Sequence
  Description of Artificial Sequence: Synthetic oligonucleotide
aaaaacuuuugcuagaaaa

SEQ ID NO: 566 - RNA, 19 nt, Artificial Sequence
  Description of Artificial Sequence: Synthetic oligonucleotide
uuuucuagcaaaaguuuuu

SEQ ID NO: 567 - RNA, 19 nt, Artificial Sequence
  Description of Artificial Sequence: Synthetic oligonucleotide
aguggccgggucugcugag

SEQ ID NO: 568 - RNA, 19 nt, Artificial Sequence
  Description of Artificial Sequence: Synthetic oligonucleotide
cucagcagacccggccacu

SEQ ID NO: 569 - RNA, 19 nt, Artificial Sequence
  Description of Artificial Sequence: Synthetic oligonucleotide
ggccgggucugcugagucc

SEQ ID NO: 570 - RNA, 19 nt, Artificial Sequence
  Description of Artificial Sequence: Synthetic oligonucleotide
ggacucagcagacccggcc

SEQ ID NO: 571 - RNA, 19 nt, Artificial Sequence
  Description of Artificial Sequence: Synthetic oligonucleotide
caggcccaguugucacccc

SEQ ID NO: 572 - RNA, 19 nt, Artificial Sequence
  Description of Artificial Sequence: Synthetic oligonucleotide
ggggugacaacugggccug

SEQ ID NO: 573 - RNA, 19 nt, Artificial Sequence
  Description of Artificial Sequence: Synthetic oligonucleotide
agaacaucuccccauggau

SEQ ID NO: 574 - RNA, 19 nt, Artificial Sequence
  Description of Artificial Sequence: Synthetic oligonucleotide
auccauggggagauguucu

SEQ ID NO: 575 - RNA, 19 nt, Artificial Sequence
  Description of Artificial Sequence: Synthetic oligonucleotide
aaggacccaguuccuuacc

SEQ ID NO: 576 - RNA, 19 nt, Artificial Sequence
  Description of Artificial Sequence: Synthetic oligonucleotide
gguaaggaacuggguccuu

SEQ ID NO: 577 - RNA, 19 nt, Artificial Sequence
  Description of Artificial Sequence: Synthetic oligonucleotide
acagagagccaagcuaaug

SEQ ID NO: 578 - RNA, 19 nt, Artificial Sequence
  Description of Artificial Sequence: Synthetic oligonucleotide
cauuagcuuggcucucugu

SEQ ID NO: 579 - RNA, 19 nt, Artificial Sequence
  Description of Artificial Sequence: Synthetic oligonucleotide
cccucagagaaugaucacc

SEQ ID NO: 580 - RNA, 19 nt, Artificial Sequence
  Description of Artificial Sequence: Synthetic oligonucleotide
ggugaucauucucugaggg

SEQ ID NO: 581 - RNA, 19 nt, Artificial Sequence
  Description of Artificial Sequence: Synthetic oligonucleotide
ucauugucucagugaagga

SEQ ID NO: 582 - RNA, 19 nt, Artificial Sequence
  Description of Artificial Sequence: Synthetic oligonucleotide
uccuucacugagacaauga

SEQ ID NO: 583 - RNA, 19 nt, Artificial Sequence
  Description of Artificial Sequence: Synthetic oligonucleotide
agcuggguaucucaaaucu

SEQ ID NO: 584 - RNA, 19 nt, Artificial Sequence
  Description of Artificial Sequence: Synthetic oligonucleotide
agauuugagauacccagcu

SEQ ID NO: 585 - RNA, 19 nt, Artificial Sequence
  Description of Artificial Sequence: Synthetic oligonucleotide
ggguaucucaaaucugcuu

SEQ ID NO: 586 - RNA, 19 nt, Artificial Sequence
  Description of Artificial Sequence: Synthetic oligonucleotide
aagcagauuugagauaccc

SEQ ID NO: 587 - RNA, 19 nt, Artificial Sequence
  Description of Artificial Sequence: Synthetic oligonucleotide
aucucaaaucugcuuucau

SEQ ID NO: 588 - RNA, 19 nt, Artificial Sequence
  Description of Artificial Sequence: Synthetic oligonucleotide
augaaagcagauuugagau

SEQ ID NO: 589 - RNA, 19 nt, Artificial Sequence
  Description of Artificial Sequence: Synthetic oligonucleotide
aaaucugcuuucauccagc

SEQ ID NO: 590 - RNA, 19 nt, Artificial Sequence
  Description of Artificial Sequence: Synthetic oligonucleotide
gcuggaugaaagcagauuu

SEQ ID NO: 591 - RNA, 19 nt, Artificial Sequence
  Description of Artificial Sequence: Synthetic oligonucleotide
aucugcuuucauccagcca

SEQ ID NO: 592 - RNA, 19 nt, Artificial Sequence
  Description of Artificial Sequence: Synthetic oligonucleotide
uggcuggaugaaagcagau

SEQ ID NO: 593 - RNA, 19 nt, Artificial Sequence
  Description of Artificial Sequence: Synthetic oligonucleotide
ucugcuuucauccagccac

SEQ ID NO: 594 - RNA, 19 nt, Artificial Sequence
  Description of Artificial Sequence: Synthetic oligonucleotide
guggcuggaugaaagcaga

SEQ ID NO: 595 - RNA, 19 nt, Artificial Sequence
  Description of Artificial Sequence: Synthetic oligonucleotide
ugcuuucauccagccacug

SEQ ID NO: 596 - RNA, 19 nt, Artificial Sequence
  Description of Artificial Sequence: Synthetic oligonucleotide
caguggcuggaugaaagca

SEQ ID NO: 597 - RNA, 19 nt, Artificial Sequence
  Description of Artificial Sequence: Synthetic oligonucleotide
gcuuucauccagccacugc

SEQ ID NO: 598 - RNA, 19 nt, Artificial Sequence
  Description of Artificial Sequence: Synthetic oligonucleotide
gcaguggcuggaugaaagc

SEQ ID NO: 599 - RNA, 19 nt, Artificial Sequence
  Description of Artificial Sequence: Synthetic oligonucleotide
cuuucauccagccacugcc

SEQ ID NO: 600 - RNA, 19 nt, Artificial Sequence
  Description of Artificial Sequence: Synthetic oligonucleotide
ggcaguggcuggaugaaag

SEQ ID NO: 601 - RNA, 19 nt, Artificial Sequence
  Description of Artificial Sequence: Synthetic oligonucleotide
uuucauccagccacugccc

SEQ ID NO: 602 - RNA, 19 nt, Artificial Sequence
  Description of Artificial Sequence: Synthetic oligonucleotide
gggcaguggcuggaugaaa

SEQ ID NO: 603 - RNA, 19 nt, Artificial Sequence
  Description of Artificial Sequence: Synthetic oligonucleotide
ccaucuuccugccuacugg

SEQ ID NO: 604 - RNA, 19 nt, Artificial Sequence
  Description of Artificial Sequence: Synthetic oligonucleotide
ccaguaggcaggaagaugg

SEQ ID NO: 605 - RNA, 19 nt, Artificial Sequence
  Description of Artificial Sequence: Synthetic oligonucleotide
caucuuccugccuacugga

SEQ ID NO: 606 - RNA, 19 nt, Artificial Sequence
  Description of Artificial Sequence: Synthetic oligonucleotide
uccaguaggcaggaagaug

SEQ ID NO: 607 - RNA, 19 nt, Artificial Sequence
  Description of Artificial Sequence: Synthetic oligonucleotide
aucuuccugccuacuggau

SEQ ID NO: 608 - RNA, 19 nt, Artificial Sequence
  Description of Artificial Sequence: Synthetic oligonucleotide
auccaguaggcaggaagau

SEQ ID NO: 609 - RNA, 19 nt, Artificial Sequence
  Description of Artificial Sequence: Synthetic oligonucleotide
ucuuccugccuacuggaug

SEQ ID NO: 610 - RNA, 19 nt, Artificial Sequence
  Description of Artificial Sequence: Synthetic oligonucleotide
cauccaguaggcaggaaga

SEQ ID NO: 611 - RNA, 19 nt, Artificial Sequence
  Description of Artificial Sequence: Synthetic oligonucleotide
uuccugccuacuggaugcu

SEQ ID NO: 612 - RNA, 19 nt, Artificial Sequence
  Description of Artificial Sequence: Synthetic oligonucleotide
agcauccaguaggcaggaa

SEQ ID NO: 613 - RNA, 19 nt, Artificial Sequence
  Description of Artificial Sequence: Synthetic oligonucleotide
ccugccuacuggaugcuua

SEQ ID NO: 614 - RNA, 19 nt, Artificial Sequence
  Description of Artificial Sequence: Synthetic oligonucleotide
uaagcauccaguaggcagg

SEQ ID NO: 615 - RNA, 19 nt, Artificial Sequence
  Description of Artificial Sequence: Synthetic oligonucleotide
uacuggaugcuuacaguga

SEQ ID NO: 616 - RNA, 19 nt, Artificial Sequence
  Description of Artificial Sequence: Synthetic oligonucleotide
ucacuguaagcauccagua

SEQ ID NO: 617 - RNA, 19 nt, Artificial Sequence
  Description of Artificial Sequence: Synthetic oligonucleotide
cuggaugcuuacagugacu

SEQ ID NO: 618 - RNA, 19 nt, Artificial Sequence
  Description of Artificial Sequence: Synthetic oligonucleotide
agucacuguaagcauccag

SEQ ID NO: 619 - RNA, 19 nt, Artificial Sequence
  Description of Artificial Sequence: Synthetic oligonucleotide
ggaugcuuacagugacugu

SEQ ID NO: 620 - RNA, 19 nt, Artificial Sequence
  Description of Artificial Sequence: Synthetic oligonucleotide
acagucacuguaagcaucc

SEQ ID NO: 621 - RNA, 19 nt, Artificial Sequence
  Description of Artificial Sequence: Synthetic oligonucleotide
augcuuacagugacugugg

SEQ ID NO: 622 - RNA, 19 nt, Artificial Sequence
  Description of Artificial Sequence: Synthetic oligonucleotide
ccacagucacuguaagcau

SEQ ID NO: 623 - RNA, 19 nt, Artificial Sequence
  Description of Artificial Sequence: Synthetic oligonucleotide
ugcuuacagugacugugga

SEQ ID NO: 624 - RNA, 19 nt, Artificial Sequence
  Description of Artificial Sequence: Synthetic oligonucleotide
uccacagucacuguaagca

SEQ ID NO: 625 - RNA, 19 nt, Artificial Sequence
  Description of Artificial Sequence: Synthetic oligonucleotide
cuuacagugacuguggaua

SEQ ID NO: 626 - RNA, 19 nt, Artificial Sequence
  Description of Artificial Sequence: Synthetic oligonucleotide
uauccacagucacuguaag

SEQ ID NO: 627 - RNA, 19 nt, Artificial Sequence
  Description of Artificial Sequence: Synthetic oligonucleotide
ugguguaaaccauucuugg

SEQ ID NO: 628 - RNA, 19 nt, Artificial Sequence
  Description of Artificial Sequence: Synthetic oligonucleotide
ccaagaaugguuuacacca

SEQ ID NO: 629 - RNA, 19 nt, Artificial Sequence
  Description of Artificial Sequence: Synthetic oligonucleotide
gguguaaaccauucuuggg

SEQ ID NO: 630 - RNA, 19 nt, Artificial Sequence
  Description of Artificial Sequence: Synthetic oligonucleotide
cccaagaaugguuuacacc

SEQ ID NO: 631 - RNA, 19 nt, Artificial Sequence
  Description of Artificial Sequence: Synthetic oligonucleotide
guaaaccauucuugggagg

SEQ ID NO: 632 - RNA, 19 nt, Artificial Sequence
  Description of Artificial Sequence: Synthetic oligonucleotide
ccucccaagaaugguuuac

SEQ ID NO: 633 - RNA, 19 nt, Artificial Sequence
  Description of Artificial Sequence: Synthetic oligonucleotide
uaaaccauucuugggagga

SEQ ID NO: 634 - RNA, 19 nt, Artificial Sequence
  Description of Artificial Sequence: Synthetic oligonucleotide
uccucccaagaaugguuua

SEQ ID NO: 635 - RNA, 19 nt, Artificial Sequence
  Description of Artificial Sequence: Synthetic oligonucleotide
aaaccauucuugggaggac

SEQ ID NO: 636 - RNA, 19 nt, Artificial Sequence
  Description of Artificial Sequence: Synthetic oligonucleotide
guccucccaagaaugguuu

SEQ ID NO: 637 - RNA, 19 nt, Artificial Sequence
  Description of Artificial Sequence: Synthetic oligonucleotide
ccauucuugggaggacacu

SEQ ID NO: 638 - RNA, 19 nt, Artificial Sequence
  Description of Artificial Sequence: Synthetic oligonucleotide
aguguccucccaagaaugg

SEQ ID NO: 639 - RNA, 19 nt, Artificial Sequence
  Description of Artificial Sequence: Synthetic oligonucleotide
gggaggacacuuuugccaa

SEQ ID NO: 640 - RNA, 19 nt, Artificial Sequence
  Description of Artificial Sequence: Synthetic oligonucleotide
uuggcaaaaguguccuccc

SEQ ID NO: 641 - RNA, 19 nt, Artificial Sequence
  Description of Artificial Sequence: Synthetic oligonucleotide
ggaggacacuuuugccaau

SEQ ID NO: 642 - RNA, 19 nt, Artificial Sequence
  Description of Artificial Sequence: Synthetic oligonucleotide
auuggcaaaaguguccucc

SEQ ID NO: 643 - RNA, 19 nt, Artificial Sequence
  Description of Artificial Sequence: Synthetic oligonucleotide
aggacacuuuugccaauga

SEQ ID NO: 644 - RNA, 19 nt, Artificial Sequence
  Description of Artificial Sequence: Synthetic oligonucleotide
ucauuggcaaaaguguccu

SEQ ID NO: 645 - RNA, 19 nt, Artificial Sequence
  Description of Artificial Sequence: Synthetic oligonucleotide
ggacacuuuugccaaugaa

SEQ ID NO: 646 - RNA, 19 nt, Artificial Sequence
  Description of Artificial Sequence: Synthetic oligonucleotide
uucauuggcaaaagugucc

SEQ ID NO: 647 - RNA, 19 nt, Artificial Sequence
  Description of Artificial Sequence: Synthetic oligonucleotide
gcugauuagugucuaagga

SEQ ID NO: 648 - RNA, 19 nt, Artificial Sequence
  Description of Artificial Sequence: Synthetic oligonucleotide
uccuuagacacuaaucagc

SEQ ID NO: 649 - RNA, 19 nt, Artificial Sequence
  Description of Artificial Sequence: Synthetic oligonucleotide
uacuguugcccuuuuccuu

SEQ ID NO: 650 - RNA, 19 nt, Artificial Sequence
  Description of Artificial Sequence: Synthetic oligonucleotide
aaggaaaagggcaacagua

SEQ ID NO: 651 - RNA, 19 nt, Artificial Sequence
  Description of Artificial Sequence: Synthetic oligonucleotide
cuguugcccuuuuccuuga

SEQ ID NO: 652 - RNA, 19 nt, Artificial Sequence
  Description of Artificial Sequence: Synthetic oligonucleotide
ucaaggaaaagggcaacag

SEQ ID NO: 653 - RNA, 19 nt, Artificial Sequence
  Description of Artificial Sequence: Synthetic oligonucleotide
uguugcccuuuuccuugac

SEQ ID NO: 654 - RNA, 19 nt, Artificial Sequence
  Description of Artificial Sequence: Synthetic oligonucleotide
gucaaggaaaagggcaaca

SEQ ID NO: 655 - RNA, 19 nt, Artificial Sequence
  Description of Artificial Sequence: Synthetic oligonucleotide
ccuugacuauuacacugcc

SEQ ID NO: 656 - RNA, 19 nt, Artificial Sequence
  Description of Artificial Sequence: Synthetic oligonucleotide
ggcaguguaauagucaagg

SEQ ID NO: 657 - RNA, 19 nt, Artificial Sequence
  Description of Artificial Sequence: Synthetic oligonucleotide
uauuacacugccuggagga

SEQ ID NO: 658 - RNA, 19 nt, Artificial Sequence
  Description of Artificial Sequence: Synthetic oligonucleotide
uccuccaggcaguguaaua

SEQ ID NO: 659 - RNA, 19 nt, Artificial Sequence
  Description of Artificial Sequence: Synthetic oligonucleotide
auuacacugccuggaggau

SEQ ID NO: 660 - RNA, 19 nt, Artificial Sequence
  Description of Artificial Sequence: Synthetic oligonucleotide
auccuccaggcaguguaau

SEQ ID NO: 661 - RNA, 19 nt, Artificial Sequence
  Description of Artificial Sequence: Synthetic oligonucleotide
uuacacugccuggaggaua

SEQ ID NO: 662 - RNA, 19 nt, Artificial Sequence
  Description of Artificial Sequence: Synthetic oligonucleotide
uauccuccaggcaguguaa

SEQ ID NO: 663 - RNA, 19 nt, Artificial Sequence
  Description of Artificial Sequence: Synthetic oligonucleotide
uacacugccuggaggauag

SEQ ID NO: 664 - RNA, 19 nt, Artificial Sequence
  Description of Artificial Sequence: Synthetic oligonucleotide
cuauccuccaggcagugua

SEQ ID NO: 665 - RNA, 19 nt, Artificial Sequence
  Description of Artificial Sequence: Synthetic oligonucleotide
ucauucaaaaagccaaaau

SEQ ID NO: 666 - RNA, 19 nt, Artificial Sequence
  Description of Artificial Sequence: Synthetic oligonucleotide
auuuuggcuuuuugaauga

SEQ ID NO: 667 - RNA, 19 nt, Artificial Sequence
  Description of Artificial Sequence: Synthetic oligonucleotide
caaaaagccaaaauagaga

SEQ ID NO: 668 - RNA, 19 nt, Artificial Sequence
  Description of Artificial Sequence: Synthetic oligonucleotide
ucucuauuuuggcuuuuug

SEQ ID NO: 669 - RNA, 19 nt, Artificial Sequence
  Description of Artificial Sequence: Synthetic oligonucleotide
aaaagccaaaauagagagu

SEQ ID NO: 670 - RNA, 19 nt, Artificial Sequence
  Description of Artificial Sequence: Synthetic oligonucleotide
acucucuauuuuggcuuuu

SEQ ID NO: 671 - RNA, 19 nt, Artificial Sequence
  Description of Artificial Sequence: Synthetic oligonucleotide
acaguccuagagaauuccu

SEQ ID NO: 672 - RNA, 19 nt, Artificial Sequence
  Description of Artificial Sequence: Synthetic oligonucleotide
aggaauucucuaggacugu

SEQ ID NO: 673 - RNA, 19 nt, Artificial Sequence
  Description of Artificial Sequence: Synthetic oligonucleotide
uauuuguucagaucucaua

SEQ ID NO: 674 - RNA, 19 nt, Artificial Sequence
  Description of Artificial Sequence: Synthetic oligonucleotide
uaugagaucugaacaaaua

SEQ ID NO: 675 - RNA, 19 nt, Artificial Sequence
  Description of Artificial Sequence: Synthetic oligonucleotide
uuuguucagaucucauaga

SEQ ID NO: 676 - RNA, 19 nt, Artificial Sequence
  Description of Artificial Sequence: Synthetic oligonucleotide
ucuaugagaucugaacaaa

SEQ ID NO: 677 - RNA, 19 nt, Artificial Sequence
  Description of Artificial Sequence: Synthetic oligonucleotide
uuguucagaucucauagau

SEQ ID NO: 678 - RNA, 19 nt, Artificial Sequence
  Description of Artificial Sequence: Synthetic oligonucleotide
aucuaugagaucugaacaa

SEQ ID NO: 679 - RNA, 19 nt, Artificial Sequence
  Description of Artificial Sequence: Synthetic oligonucleotide
uuuugacauccagcagucc

SEQ ID NO: 680 - RNA, 19 nt, Artificial Sequence
  Description of Artificial Sequence: Synthetic oligonucleotide
ggacugcuggaugucaaaa

SEQ ID NO: 681 - RNA, 19 nt, Artificial Sequence
  Description of Artificial Sequence: Synthetic oligonucleotide
uuugacauccagcagucca

SEQ ID NO: 682 - RNA, 19 nt, Artificial Sequence
  Description of Artificial Sequence: Synthetic oligonucleotide
uggacugcuggaugucaaa

SEQ ID NO: 683 - RNA, 19 nt, Artificial Sequence
  Description of Artificial Sequence: Synthetic oligonucleotide
uugacauccagcaguccaa

SEQ ID NO: 684 - RNA, 19 nt, Artificial Sequence
  Description of Artificial Sequence: Synthetic oligonucleotide
uuggacugcuggaugucaa

SEQ ID NO: 685 - RNA, 19 nt, Artificial Sequence
  Description of Artificial Sequence: Synthetic oligonucleotide
ugcuucugucggggcagcc

SEQ ID NO: 686 - RNA, 19 nt, Artificial Sequence
  Description of Artificial Sequence: Synthetic oligonucleotide
ggcugccccgacagaagca

SEQ ID NO: 687 - RNA, 19 nt, Artificial Sequence
  Description of Artificial Sequence: Synthetic oligonucleotide
aaauauuacuauaauugag

SEQ ID NO: 688 - RNA, 19 nt, Artificial Sequence
  Description of Artificial Sequence: Synthetic oligonucleotide
cucaauuauaguaauauuu

SEQ ID NO: 689 - RNA, 19 nt, Artificial Sequence
  Description of Artificial Sequence: Synthetic oligonucleotide
aauauuacuauaauugaga

SEQ ID NO: 690 - RNA, 19 nt, Artificial Sequence
  Description of Artificial Sequence: Synthetic oligonucleotide
ucucaauuauaguaauauu

SEQ ID NO: 691 - RNA, 19 nt, Artificial Sequence
  Description of Artificial Sequence: Synthetic oligonucleotide
auuacuauaauugagaacu

SEQ ID NO: 692 - RNA, 19 nt, Artificial Sequence
  Description of Artificial Sequence: Synthetic oligonucleotide
aguucucaauuauaguaau

SEQ ID NO: 693 - RNA, 19 nt, Artificial Sequence
  Description of Artificial Sequence: Synthetic oligonucleotide
gcuucugucggggcagccc

SEQ ID NO: 694 - RNA, 19 nt, Artificial Sequence
  Description of Artificial Sequence: Synthetic oligonucleotide
gggcugccccgacagaagc

SEQ ID NO: 695 - RNA, 19 nt, Artificial Sequence
  Description of Artificial Sequence: Synthetic oligonucleotide
uuacuauaauugagaacua

SEQ ID NO: 696 - RNA, 19 nt, Artificial Sequence
  Description of Artificial Sequence: Synthetic oligonucleotide
uaguucucaauuauaguaa

SEQ ID NO: 697 - RNA, 19 nt, Artificial Sequence
  Description of Artificial Sequence: Synthetic oligonucleotide
acuauaauugagaacuaca

SEQ ID NO: 698 - RNA, 19 nt, Artificial Sequence
  Description of Artificial Sequence: Synthetic oligonucleotide
uguaguucucaauuauagu

SEQ ID NO: 699 - RNA, 19 nt, Artificial Sequence
  Description of Artificial Sequence: Synthetic oligonucleotide
uauaauugagaacuacagc

SEQ ID NO: 700 - RNA, 19 nt, Artificial Sequence
  Description of Artificial Sequence: Synthetic oligonucleotide
gcuguaguucucaauuaua

SEQ ID NO: 701 - RNA, 19 nt, Artificial Sequence
  Description of Artificial Sequence: Synthetic oligonucleotide
auaauugagaacuacagcu

SEQ ID NO: 702 - RNA, 19 nt, Artificial Sequence
  Description of Artificial Sequence: Synthetic oligonucleotide
agcuguaguucucaauuau

SEQ ID NO: 703 - RNA, 19 nt, Artificial Sequence
  Description of Artificial Sequence: Synthetic oligonucleotide
uaauugagaacuacagcuu

SEQ ID NO: 704 - RNA, 19 nt, Artificial Sequence
  Description of Artificial Sequence: Synthetic oligonucleotide
aagcuguaguucucaauua

SEQ ID NO: 705 - RNA, 19 nt, Artificial Sequence
  Description of Artificial Sequence: Synthetic oligonucleotide
uugagaacuacagcuuuua

SEQ ID NO: 706 - RNA, 19 nt, Artificial Sequence
  Description of Artificial Sequence: Synthetic oligonucleotide
uaaaagcuguaguucucaa

SEQ ID NO: 707 - RNA, 19 nt, Artificial Sequence
  Description of Artificial Sequence: Synthetic oligonucleotide
ugagaacuacagcuuuuaa

SEQ ID NO: 708 - RNA, 19 nt, Artificial Sequence
  Description of Artificial Sequence: Synthetic oligonucleotide
uuaaaagcuguaguucuca

SEQ ID NO: 709 - RNA, 19 nt, Artificial Sequence
  Description of Artificial Sequence: Synthetic oligonucleotide
agaacuacagcuuuuaaga

SEQ ID NO: 710 - RNA, 19 nt, Artificial Sequence
  Description of Artificial Sequence: Synthetic oligonucleotide
ucuuaaaagcuguaguucu

SEQ ID NO: 711 - RNA, 19 nt, Artificial Sequence
  Description of Artificial Sequence: Synthetic oligonucleotide
cuacagcuuuuaagauugu

SEQ ID NO: 712 - RNA, 19 nt, Artificial Sequence
  Description of Artificial Sequence: Synthetic oligonucleotide
acaaucuuaaaagcuguag

SEQ ID NO: 713 - RNA, 19 nt, Artificial Sequence
  Description of Artificial Sequence: Synthetic oligonucleotide
uucugucggggcagcccgc

SEQ ID NO: 714 - RNA, 19 nt, Artificial Sequence
  Description of Artificial Sequence: Synthetic oligonucleotide
gcgggcugccccgacagaa

SEQ ID NO: 715 - RNA, 19 nt, Artificial Sequence
  Description of Artificial Sequence: Synthetic oligonucleotide
gcuuuuaagauuguacuuu

SEQ ID NO: 716 - RNA, 19 nt, Artificial Sequence
  Description of Artificial Sequence: Synthetic oligonucleotide
aaaguacaaucuuaaaagc

SEQ ID NO: 717 - RNA, 19 nt, Artificial Sequence
  Description of Artificial Sequence: Synthetic oligonucleotide
cuuuuaagauuguacuuuu

SEQ ID NO: 718 - RNA, 19 nt, Artificial Sequence
  Description of Artificial Sequence: Synthetic oligonucleotide
aaaaguacaaucuuaaaag

SEQ ID NO: 719 - RNA, 19 nt, Artificial Sequence
  Description of Artificial Sequence: Synthetic oligonucleotide
uuuuaagauuguacuuuua

SEQ ID NO: 720 - RNA, 19 nt, Artificial Sequence
  Description of Artificial Sequence: Synthetic oligonucleotide
uaaaaguacaaucuuaaaa

SEQ ID NO: 721 - RNA, 19 nt, Artificial Sequence
  Description of Artificial Sequence: Synthetic oligonucleotide
uuuaagauuguacuuuuau

SEQ ID NO: 722 - RNA, 19 nt, Artificial Sequence
  Description of Artificial Sequence: Synthetic oligonucleotide
auaaaaguacaaucuuaaa

SEQ ID NO: 723 - RNA, 19 nt, Artificial Sequence
  Description of Artificial Sequence: Synthetic oligonucleotide
uuaagauuguacuuuuauc

SEQ ID NO: 724 - RNA, 19 nt, Artificial Sequence
  Description of Artificial Sequence: Synthetic oligonucleotide
gauaaaaguacaaucuuaa

SEQ ID NO: 725 - RNA, 19 nt, Artificial Sequence
  Description of Artificial Sequence: Synthetic oligonucleotide
agauuguacuuuuaucuua

SEQ ID NO: 726 - RNA, 19 nt, Artificial Sequence
  Description of Artificial Sequence: Synthetic oligonucleotide
uaagauaaaaguacaaucu

SEQ ID NO: 727 - RNA, 19 nt, Artificial Sequence
  Description of Artificial Sequence: Synthetic oligonucleotide
uuguacuuuuaucuuaaaa

SEQ ID NO: 728 - RNA, 19 nt, Artificial Sequence
  Description of Artificial Sequence: Synthetic oligonucleotide
uuuuaagauaaaaguacaa

SEQ ID NO: 729 - RNA, 19 nt, Artificial Sequence
  Description of Artificial Sequence: Synthetic oligonucleotide
acuuuuaucuuaaaagggu

SEQ ID NO: 730 - RNA, 19 nt, Artificial Sequence
  Description of Artificial Sequence: Synthetic oligonucleotide
acccuuuuaagauaaaagu

SEQ ID NO: 731 - RNA, 19 nt, Artificial Sequence
  Description of Artificial Sequence: Synthetic oligonucleotide
cuuuuaucuuaaaagggug

SEQ ID NO: 732 - RNA, 19 nt, Artificial Sequence
  Description of Artificial Sequence: Synthetic oligonucleotide
cacccuuuuaagauaaaag

SEQ ID NO: 733 - RNA, 19 nt, Artificial Sequence
  Description of Artificial Sequence: Synthetic oligonucleotide
cugucggggcagcccgccu

SEQ ID NO: 734 - RNA, 19 nt, Artificial Sequence
  Description of Artificial Sequence: Synthetic oligonucleotide
aggcgggcugccccgacag

SEQ ID NO: 735 - RNA, 19 nt, Artificial Sequence
  Description of Artificial Sequence: Synthetic oligonucleotide
cuuaaaagggugguaguuu

SEQ ID NO: 736 - RNA, 19 nt, Artificial Sequence
  Description of Artificial Sequence: Synthetic oligonucleotide
aaacuaccacccuuuuaag

SEQ ID NO: 737 - RNA, 19 nt, Artificial Sequence
  Description of Artificial Sequence: Synthetic oligonucleotide
cccuaaaauacuuauuaug

SEQ ID NO: 738 - RNA, 19 nt, Artificial Sequence
  Description of Artificial Sequence: Synthetic oligonucleotide
cauaauaaguauuuuaggg

SEQ ID NO: 739 - RNA, 19 nt, Artificial Sequence
  Description of Artificial Sequence: Synthetic oligonucleotide
ccuaaaauacuuauuaugu

SEQ ID NO: 740 - RNA, 19 nt, Artificial Sequence
  Description of Artificial Sequence: Synthetic oligonucleotide
acauaauaaguauuuuagg

SEQ ID NO: 741 - RNA, 19 nt, Artificial Sequence
  Description of Artificial Sequence: Synthetic oligonucleotide
uaaaauacuuauuauguaa

SEQ ID NO: 742 - RNA, 19 nt, Artificial Sequence
  Description of Artificial Sequence: Synthetic oligonucleotide
uuacauaauaaguauuuua

SEQ ID NO: 743 - RNA, 19 nt, Artificial Sequence
  Description of Artificial Sequence: Synthetic oligonucleotide
aaaauacuuauuauguaag

SEQ ID NO: 744 - RNA, 19 nt, Artificial Sequence
  Description of Artificial Sequence: Synthetic oligonucleotide
cuuacauaauaaguauuuu

SEQ ID NO: 745 - RNA, 19 nt, Artificial Sequence
  Description of Artificial Sequence: Synthetic oligonucleotide
aaauacuuauuauguaagg

SEQ ID NO: 746 - RNA, 19 nt, Artificial Sequence
  Description of Artificial Sequence: Synthetic oligonucleotide
ccuuacauaauaaguauuu

SEQ ID NO: 747 - RNA, 19 nt, Artificial Sequence
  Description of Artificial Sequence: Synthetic oligonucleotide
ucggggcagcccgccuccg

SEQ ID NO: 748 - RNA, 19 nt, Artificial Sequence
  Description of Artificial Sequence: Synthetic oligonucleotide
cggaggcgggcugccccga

SEQ ID NO: 749 - RNA, 19 nt, Artificial Sequence
  Description of Artificial Sequence: Synthetic oligonucleotide
uuauuauguaagggucauu

SEQ ID NO: 750 - RNA, 19 nt, Artificial Sequence
  Description of Artificial Sequence: Synthetic oligonucleotide
aaugacccuuacauaauaa

SEQ ID NO: 751 - RNA, 19 nt, Artificial Sequence
  Description of Artificial Sequence: Synthetic oligonucleotide
uauuauguaagggucauua

SEQ ID NO: 752 - RNA, 19 nt, Artificial Sequence
  Description of Artificial Sequence: Synthetic oligonucleotide
uaaugacccuuacauaaua

SEQ ID NO: 753 - RNA, 19 nt, Artificial Sequence
  Description of Artificial Sequence: Synthetic oligonucleotide
cggggcagcccgccuccgc

SEQ ID NO: 754 - RNA, 19 nt, Artificial Sequence
  Description of Artificial Sequence: Synthetic oligonucleotide
gcggaggcgggcugccccg

SEQ ID NO: 755 - RNA, 19 nt, Artificial Sequence
  Description of Artificial Sequence: Synthetic oligonucleotide
ucauuagacaaaugucuug

SEQ ID NO: 756 - RNA, 19 nt, Artificial Sequence
  Description of Artificial Sequence: Synthetic oligonucleotide
caagacauuugucuaauga

SEQ ID NO: 757 - RNA, 19 nt, Artificial Sequence
  Description of Artificial Sequence: Synthetic oligonucleotide
auuagacaaaugucuugaa

SEQ ID NO: 758 - RNA, 19 nt, Artificial Sequence
  Description of Artificial Sequence: Synthetic oligonucleotide
uucaagacauuugucuaau

SEQ ID NO: 759 - RNA, 19 nt, Artificial Sequence
  Description of Artificial Sequence: Synthetic oligonucleotide
agacaaaugucuugaagua

SEQ ID NO: 760 - RNA, 19 nt, Artificial Sequence
  Description of Artificial Sequence: Synthetic oligonucleotide
uacuucaagacauuugucu

SEQ ID NO: 761 - RNA, 19 nt, Artificial Sequence
  Description of Artificial Sequence: Synthetic oligonucleotide
gacaaaugucuugaaguag

SEQ ID NO: 762 - RNA, 19 nt, Artificial Sequence
  Description of Artificial Sequence: Synthetic oligonucleotide
cuacuucaagacauuuguc

SEQ ID NO: 763 - RNA, 19 nt, Artificial Sequence
  Description of Artificial Sequence: Synthetic oligonucleotide
acaaaugucuugaaguaga

SEQ ID NO: 764 - RNA, 19 nt, Artificial Sequence
  Description of Artificial Sequence: Synthetic oligonucleotide
ucuacuucaagacauuugu

SEQ ID NO: 765 - RNA, 19 nt, Artificial Sequence
  Description of Artificial Sequence: Synthetic oligonucleotide
augaaugguucuuuaucau

SEQ ID NO: 766 - RNA, 19 nt, Artificial Sequence
  Description of Artificial Sequence: Synthetic oligonucleotide
augauaaagaaccauucau

SEQ ID NO: 767 - RNA, 19 nt, Artificial Sequence
  Description of Artificial Sequence: Synthetic oligonucleotide
aaugguucuuuaucauuuc

SEQ ID NO: 768 - RNA, 19 nt, Artificial Sequence
  Description of Artificial Sequence: Synthetic oligonucleotide
gaaaugauaaagaaccauu

SEQ ID NO: 769 - RNA, 19 nt, Artificial Sequence
  Description of Artificial Sequence: Synthetic oligonucleotide
augguucuuuaucauuucu

SEQ ID NO: 770 - RNA, 19 nt, Artificial Sequence
  Description of Artificial Sequence: Synthetic oligonucleotide
agaaaugauaaagaaccau

SEQ ID NO: 771 - RNA, 19 nt, Artificial Sequence
  Description of Artificial Sequence: Synthetic oligonucleotide
ugguucuuuaucauuucuc

SEQ ID NO: 772 - RNA, 19 nt, Artificial Sequence
  Description of Artificial Sequence: Synthetic oligonucleotide
gagaaaugauaaagaacca

SEQ ID NO: 773 - RNA, 19 nt, Artificial Sequence
  Description of Artificial Sequence: Synthetic oligonucleotide
guucuuuaucauuucucuu

SEQ ID NO: 774 - RNA, 19 nt, Artificial Sequence
  Description of Artificial Sequence: Synthetic oligonucleotide
aagagaaaugauaaagaac

SEQ ID NO: 775 - RNA, 19 nt, Artificial Sequence
  Description of Artificial Sequence: Synthetic oligonucleotide
uuaucauuucucuuccccc

SEQ ID NO: 776 - RNA, 19 nt, Artificial Sequence
  Description of Artificial Sequence: Synthetic oligonucleotide
gggggaagagaaaugauaa

SEQ ID NO: 777 - RNA, 19 nt, Artificial Sequence
  Description of Artificial Sequence: Synthetic oligonucleotide
uaucauuucucuucccccu

SEQ ID NO: 778 - RNA, 19 nt, Artificial Sequence
  Description of Artificial Sequence: Synthetic oligonucleotide
agggggaagagaaaugaua

SEQ ID NO: 779 - RNA, 19 nt, Artificial Sequence
  Description of Artificial Sequence: Synthetic oligonucleotide
cauuucucuucccccuuuu

SEQ ID NO: 780 - RNA, 19 nt, Artificial Sequence
  Description of Artificial Sequence: Synthetic oligonucleotide
aaaagggggaagagaaaug

SEQ ID NO: 781 - RNA, 19 nt, Artificial Sequence
  Description of Artificial Sequence: Synthetic oligonucleotide
uuucucuucccccuuuuug

SEQ ID NO: 782 - RNA, 19 nt, Artificial Sequence
  Description of Artificial Sequence: Synthetic oligonucleotide
caaaaagggggaagagaaa

SEQ ID NO: 783 - RNA, 19 nt, Artificial Sequence
  Description of Artificial Sequence: Synthetic oligonucleotide
uucucuucccccuuuuugg

SEQ ID NO: 784 - RNA, 19 nt, Artificial Sequence
  Description of Artificial Sequence: Synthetic oligonucleotide
ccaaaaagggggaagagaa

SEQ ID NO: 785 - RNA, 19 nt, Artificial Sequence
  Description of Artificial Sequence: Synthetic oligonucleotide
cuucccccuuuuuggcauc

SEQ ID NO: 786 - RNA, 19 nt, Artificial Sequence
  Description of Artificial Sequence: Synthetic oligonucleotide
gaugccaaaaagggggaag

SEQ ID NO: 787 - RNA, 19 nt, Artificial Sequence
  Description of Artificial Sequence: Synthetic oligonucleotide
cccccuuuuuggcauccug

SEQ ID NO: 788 - RNA, 19 nt, Artificial Sequence
  Description of Artificial Sequence: Synthetic oligonucleotide
caggaugccaaaaaggggg

SEQ ID NO: 789 - RNA, 19 nt, Artificial Sequence
  Description of Artificial Sequence: Synthetic oligonucleotide
uuuuuggcauccuggcuug

SEQ ID NO: 790 - RNA, 19 nt, Artificial Sequence
  Description of Artificial Sequence: Synthetic oligonucleotide
caagccaggaugccaaaaa

SEQ ID NO: 791 - RNA, 19 nt, Artificial Sequence
  Description of Artificial Sequence: Synthetic oligonucleotide
uuuuggcauccuggcuugc

SEQ ID NO: 792 - RNA, 19 nt, Artificial Sequence
  Description of Artificial Sequence: Synthetic oligonucleotide
gcaagccaggaugccaaaa

SEQ ID NO: 793 - RNA, 19 nt, Artificial Sequence
  Description of Artificial Sequence: Synthetic oligonucleotide
uuuggcauccuggcuugcc

SEQ ID NO: 794 - RNA, 19 nt, Artificial Sequence
  Description of Artificial Sequence: Synthetic oligonucleotide
ggcaagccaggaugccaaa

SEQ ID NO: 795 - RNA, 19 nt, Artificial Sequence
  Description of Artificial Sequence: Synthetic oligonucleotide
uuggcauccuggcuugccu

SEQ ID NO: 796 - RNA, 19 nt, Artificial Sequence
  Description of Artificial Sequence: Synthetic oligonucleotide
aggcaagccaggaugccaa

SEQ ID NO: 797 - RNA, 19 nt, Artificial Sequence
  Description of Artificial Sequence: Synthetic oligonucleotide
ggcauccuggcuugccucc

SEQ ID NO: 798 - RNA, 19 nt, Artificial Sequence
  Description of Artificial Sequence: Synthetic oligonucleotide
ggaggcaagccaggaugcc

SEQ ID NO: 799 - RNA, 19 nt, Artificial Sequence
  Description of Artificial Sequence: Synthetic oligonucleotide
gcauccuggcuugccucca

SEQ ID NO: 800 - RNA, 19 nt, Artificial Sequence
  Description of Artificial Sequence: Synthetic oligonucleotide
uggaggcaagccaggaugc

SEQ ID NO: 801 - RNA, 19 nt, Artificial Sequence
  Description of Artificial Sequence: Synthetic oligonucleotide
auccuggcuugccuccagu

SEQ ID NO: 802 - RNA, 19 nt, Artificial Sequence
  Description of Artificial Sequence: Synthetic oligonucleotide
acuggaggcaagccaggau

SEQ ID NO: 803 - RNA, 19 nt, Artificial Sequence
  Description of Artificial Sequence: Synthetic oligonucleotide
cuggcuugccuccaguuuu

SEQ ID NO: 804 - RNA, 19 nt, Artificial Sequence
  Description of Artificial Sequence: Synthetic oligonucleotide
aaaacuggaggcaagccag

SEQ ID NO: 805 - RNA, 19 nt, Artificial Sequence
  Description of Artificial Sequence: Synthetic oligonucleotide
uggcuugccuccaguuuua

SEQ ID NO: 806 - RNA, 19 nt, Artificial Sequence
  Description of Artificial Sequence: Synthetic oligonucleotide
uaaaacuggaggcaagcca

SEQ ID NO: 807 - RNA, 19 nt, Artificial Sequence
  Description of Artificial Sequence: Synthetic oligonucleotide
ugccuccaguuuuaggucc

SEQ ID NO: 808 - RNA, 19 nt, Artificial Sequence
  Description of Artificial Sequence: Synthetic oligonucleotide
ggaccuaaaacuggaggca

SEQ ID NO: 809 - RNA, 19 nt, Artificial Sequence
  Description of Artificial Sequence: Synthetic oligonucleotide
uaguuugcuucuguaagca

SEQ ID NO: 810 - RNA, 19 nt, Artificial Sequence
  Description of Artificial Sequence: Synthetic oligonucleotide
ugcuuacagaagcaaacua

SEQ ID NO: 811 - RNA, 19 nt, Artificial Sequence
  Description of Artificial Sequence: Synthetic oligonucleotide
aguuugcuucuguaagcaa

SEQ ID NO: 812 - RNA, 19 nt, Artificial Sequence
  Description of Artificial Sequence: Synthetic oligonucleotide
uugcuuacagaagcaaacu

SEQ ID NO: 813 - RNA, 19 nt, Artificial Sequence
  Description of Artificial Sequence: Synthetic oligonucleotide
accugcugagggggcucuu

SEQ ID NO: 814 - RNA, 19 nt, Artificial Sequence
  Description of Artificial Sequence: Synthetic oligonucleotide
aagagcccccucagcaggu

SEQ ID NO: 815 - RNA, 19 nt, Artificial Sequence
  Description of Artificial Sequence: Synthetic oligonucleotide
cugcugagggggcucuuuc

SEQ ID NO: 816 - RNA, 19 nt, Artificial Sequence
  Description of Artificial Sequence: Synthetic oligonucleotide
gaaagagcccccucagcag

SEQ ID NO: 817 - RNA, 19 nt, Artificial Sequence
  Description of Artificial Sequence: Synthetic oligonucleotide
ugcugagggggcucuuucc

SEQ ID NO: 818 - RNA, 19 nt, Artificial Sequence
  Description of Artificial Sequence: Synthetic oligonucleotide
ggaaagagcccccucagca

SEQ ID NO: 819 - RNA, 19 nt, Artificial Sequence
  Description of Artificial Sequence: Synthetic oligonucleotide
gcugagggggcucuuuccc

SEQ ID NO: 820 - RNA, 19 nt, Artificial Sequence
  Description of Artificial Sequence: Synthetic oligonucleotide
gggaaagagcccccucagc

SEQ ID NO: 821 - RNA, 19 nt, Artificial Sequence
  Description of Artificial Sequence: Synthetic oligonucleotide
cugagggggcucuuucccu

SEQ ID NO: 822 - RNA, 19 nt, Artificial Sequence
  Description of Artificial Sequence: Synthetic oligonucleotide
agggaaagagcccccucag

SEQ ID NO: 823 - RNA, 19 nt, Artificial Sequence
  Description of Artificial Sequence: Synthetic oligonucleotide
ugagggggcucuuucccuc

SEQ ID NO: 824 - RNA, 19 nt, Artificial Sequence
  Description of Artificial Sequence: Synthetic oligonucleotide
gagggaaagagcccccuca

SEQ ID NO: 825 - RNA, 19 nt, Artificial Sequence
  Description of Artificial Sequence: Synthetic oligonucleotide
aaguaagaucaagaaucuu

SEQ ID NO: 826 - RNA, 19 nt, Artificial Sequence
  Description of Artificial Sequence: Synthetic oligonucleotide
aagauucuugaucuuacuu

SEQ ID NO: 827 - RNA, 19 nt, Artificial Sequence
  Description of Artificial Sequence: Synthetic oligonucleotide
aguaagaucaagaaucuuu

SEQ ID NO: 828 - RNA, 19 nt, Artificial Sequence
  Description of Artificial Sequence: Synthetic oligonucleotide
aaagauucuugaucuuacu

SEQ ID NO: 829 - RNA, 19 nt, Artificial Sequence
  Description of Artificial Sequence: Synthetic oligonucleotide
guaagaucaagaaucuuuu

SEQ ID NO: 830 - RNA, 19 nt, Artificial Sequence
  Description of Artificial Sequence: Synthetic oligonucleotide
aaaagauucuugaucuuac

SEQ ID NO: 831 - RNA, 19 nt, Artificial Sequence
  Description of Artificial Sequence: Synthetic oligonucleotide
uaagaucaagaaucuuuug

SEQ ID NO: 832 - RNA, 19 nt, Artificial Sequence
  Description of Artificial Sequence: Synthetic oligonucleotide
caaaagauucuugaucuua

SEQ ID NO: 833 - RNA, 19 nt, Artificial Sequence
  Description of Artificial Sequence: Synthetic oligonucleotide
aagaucaagaaucuuuugu

SEQ ID NO: 834 - RNA, 19 nt, Artificial Sequence
  Description of Artificial Sequence: Synthetic oligonucleotide
acaaaagauucuugaucuu

SEQ ID NO: 835 - RNA, 19 nt, Artificial Sequence
  Description of Artificial Sequence: Synthetic oligonucleotide
agaucaagaaucuuuugug

SEQ ID NO: 836 - RNA, 19 nt, Artificial Sequence
  Description of Artificial Sequence: Synthetic oligonucleotide
cacaaaagauucuugaucu

SEQ ID NO: 837 - RNA, 19 nt, Artificial Sequence
  Description of Artificial Sequence: Synthetic oligonucleotide
ucaagaaucuuuugugaaa

SEQ ID NO: 838 - RNA, 19 nt, Artificial Sequence
  Description of Artificial Sequence: Synthetic oligonucleotide
uuucacaaaagauucuuga

SEQ ID NO: 839 - RNA, 19 nt, Artificial Sequence
  Description of Artificial Sequence: Synthetic oligonucleotide
uagaaauuuacuauguaaa

SEQ ID NO: 840 - RNA, 19 nt, Artificial Sequence
  Description of Artificial Sequence: Synthetic oligonucleotide
uuuacauaguaaauuucua

SEQ ID NO: 841 - RNA, 19 nt, Artificial Sequence
  Description of Artificial Sequence: Synthetic oligonucleotide
agaaauuuacuauguaaau

SEQ ID NO: 842 - RNA, 19 nt, Artificial Sequence
  Description of Artificial Sequence: Synthetic oligonucleotide
auuuacauaguaaauuucu

SEQ ID NO: 843 - RNA, 19 nt, Artificial Sequence
  Description of Artificial Sequence: Synthetic oligonucleotide
gaaauuuacuauguaaaug

SEQ ID NO: 844 - RNA, 19 nt, Artificial Sequence
  Description of Artificial Sequence: Synthetic oligonucleotide
cauuuacauaguaaauuuc

SEQ ID NO: 845 - RNA, 19 nt, Artificial Sequence
  Description of Artificial Sequence: Synthetic oligonucleotide
aaauuuacuauguaaaugc

SEQ ID NO: 846 - RNA, 19 nt, Artificial Sequence
  Description of Artificial Sequence: Synthetic oligonucleotide
gcauuuacauaguaaauuu

SEQ ID NO: 847 - RNA, 19 nt, Artificial Sequence
  Description of Artificial Sequence: Synthetic oligonucleotide
auuuacuauguaaaugcuu

SEQ ID NO: 848 - RNA, 19 nt, Artificial Sequence
  Description of Artificial Sequence: Synthetic oligonucleotide
aagcauuuacauaguaaau

SEQ ID NO: 849 - RNA, 19 nt, Artificial Sequence
  Description of Artificial Sequence: Synthetic oligonucleotide
uuuacuauguaaaugcuug

SEQ ID NO: 850 - RNA, 19 nt, Artificial Sequence
  Description of Artificial Sequence: Synthetic oligonucleotide
caagcauuuacauaguaaa

SEQ ID NO: 851 - RNA, 19 nt, Artificial Sequence
  Description of Artificial Sequence: Synthetic oligonucleotide
uacuauguaaaugcuugau

SEQ ID NO: 852 - RNA, 19 nt, Artificial Sequence
  Description of Artificial Sequence: Synthetic oligonucleotide
aucaagcauuuacauagua

SEQ ID NO: 853 - RNA, 19 nt, Artificial Sequence
  Description of Artificial Sequence: Synthetic oligonucleotide
cuauguaaaugcuugaugg

SEQ ID NO: 854 - RNA, 19 nt, Artificial Sequence
  Description of Artificial Sequence: Synthetic oligonucleotide
ccaucaagcauuuacauag

SEQ ID NO: 855 - RNA, 19 nt, Artificial Sequence
  Description of Artificial Sequence: Synthetic oligonucleotide
auguaaaugcuugauggaa

SEQ ID NO: 856 - RNA, 19 nt, Artificial Sequence
  Description of Artificial Sequence: Synthetic oligonucleotide
uuccaucaagcauuuacau

SEQ ID NO: 857 - RNA, 19 nt, Artificial Sequence
  Description of Artificial Sequence: Synthetic oligonucleotide
uguaaaugcuugauggaau

SEQ ID NO: 858 - RNA, 19 nt, Artificial Sequence
  Description of Artificial Sequence: Synthetic oligonucleotide
auuccaucaagcauuuaca

SEQ ID NO: 859 - RNA, 19 nt, Artificial Sequence
  Description of Artificial Sequence: Synthetic oligonucleotide
guaaaugcuugauggaauu

SEQ ID NO: 860 - RNA, 19 nt, Artificial Sequence
  Description of Artificial Sequence: Synthetic oligonucleotide
aauuccaucaagcauuuac

SEQ ID NO: 861 - RNA, 19 nt, Artificial Sequence
  Description of Artificial Sequence: Synthetic oligonucleotide
aaugcuugauggaauuuuu

SEQ ID NO: 862 - RNA, 19 nt, Artificial Sequence
  Description of Artificial Sequence: Synthetic oligonucleotide
aaaaauuccaucaagcauu

SEQ ID NO: 863 - RNA, 19 nt, Artificial Sequence
  Description of Artificial Sequence: Synthetic oligonucleotide
augcuugauggaauuuuuu

SEQ ID NO: 864 - RNA, 19 nt, Artificial Sequence
  Description of Artificial Sequence: Synthetic oligonucleotide
aaaaaauuccaucaagcau

SEQ ID NO: 865 - RNA, 19 nt, Artificial Sequence
  Description of Artificial Sequence: Synthetic oligonucleotide
ugcuugauggaauuuuuuc

SEQ ID NO: 866 - RNA, 19 nt, Artificial Sequence
  Description of Artificial Sequence: Synthetic oligonucleotide
gaaaaaauuccaucaagca

SEQ ID NO: 867 - RNA, 19 nt, Artificial Sequence
  Description of Artificial Sequence: Synthetic oligonucleotide
gcuugauggaauuuuuucc

SEQ ID NO: 868 - RNA, 19 nt, Artificial Sequence
  Description of Artificial Sequence: Synthetic oligonucleotide
ggaaaaaauuccaucaagc

SEQ ID NO: 869 - RNA, 19 nt, Artificial Sequence
  Description of Artificial Sequence: Synthetic oligonucleotide
ggaauuuuuuccugcuagu

SEQ ID NO: 870 - RNA, 19 nt, Artificial Sequence
  Description of Artificial Sequence: Synthetic oligonucleotide
acuagcaggaaaaaauucc

SEQ ID NO: 871 - RNA, 19 nt, Artificial Sequence
  Description of Artificial Sequence: Synthetic oligonucleotide
auuuuuuccugcuagugua

SEQ ID NO: 872 - RNA, 19 nt, Artificial Sequence
  Description of Artificial Sequence: Synthetic oligonucleotide
uacacuagcaggaaaaaau

SEQ ID NO: 873 - RNA, 19 nt, Artificial Sequence
  Description of Artificial Sequence: Synthetic oligonucleotide
ccugcuaguguagcuucug

SEQ ID NO: 874 - RNA, 19 nt, Artificial Sequence
  Description of Artificial Sequence: Synthetic oligonucleotide
cagaagcuacacuagcagg

SEQ ID NO: 875 - RNA, 19 nt, Artificial Sequence
  Description of Artificial Sequence: Synthetic oligonucleotide
cugcuaguguagcuucuga

SEQ ID NO: 876 - RNA, 19 nt, Artificial Sequence
  Description of Artificial Sequence: Synthetic oligonucleotide
ucagaagcuacacuagcag

SEQ ID NO: 877 - RNA, 19 nt, Artificial Sequence
  Description of Artificial Sequence: Synthetic oligonucleotide
gcuaguguagcuucugaaa

SEQ ID NO: 878 - RNA, 19 nt, Artificial Sequence
  Description of Artificial Sequence: Synthetic oligonucleotide
uuucagaagcuacacuagc

SEQ ID NO: 879 - RNA, 19 nt, Artificial Sequence
  Description of Artificial Sequence: Synthetic oligonucleotide
cuaguguagcuucugaaag

SEQ ID NO: 880 - RNA, 19 nt, Artificial Sequence
  Description of Artificial Sequence: Synthetic oligonucleotide
cuuucagaagcuacacuag

SEQ ID NO: 881 - RNA, 19 nt, Artificial Sequence
  Description of Artificial Sequence: Synthetic oligonucleotide
uaguguagcuucugaaagg

SEQ ID NO: 882 - RNA, 19 nt, Artificial Sequence
  Description of Artificial Sequence: Synthetic oligonucleotide
ccuuucagaagcuacacua

SEQ ID NO: 883 - RNA, 19 nt, Artificial Sequence
  Description of Artificial Sequence: Synthetic oligonucleotide
aguguagcuucugaaaggu

SEQ ID NO: 884 - RNA, 19 nt, Artificial Sequence
  Description of Artificial Sequence: Synthetic oligonucleotide
accuuucagaagcuacacu

SEQ ID NO: 885 - RNA, 19 nt, Artificial Sequence
  Description of Artificial Sequence: Synthetic oligonucleotide
guguagcuucugaaaggug

SEQ ID NO: 886 - RNA, 19 nt, Artificial Sequence
  Description of Artificial Sequence: Synthetic oligonucleotide
caccuuucagaagcuacac

SEQ ID NO: 887 - RNA, 19 nt, Artificial Sequence
  Description of Artificial Sequence: Synthetic oligonucleotide
guagcuucugaaaggugcu

SEQ ID NO: 888 - RNA, 19 nt, Artificial Sequence
  Description of Artificial Sequence: Synthetic oligonucleotide
agcaccuuucagaagcuac

SEQ ID NO: 889 - RNA, 19 nt, Artificial Sequence
  Description of Artificial Sequence: Synthetic oligonucleotide
gcuucugaaaggugcuuuc

SEQ ID NO: 890 - RNA, 19 nt, Artificial Sequence
  Description of Artificial Sequence: Synthetic oligonucleotide
gaaagcaccuuucagaagc

SEQ ID NO: 891 - RNA, 19 nt, Artificial Sequence
  Description of Artificial Sequence: Synthetic oligonucleotide
uuuauuuaaaacuacccau

SEQ ID NO: 892 - RNA, 19 nt, Artificial Sequence
  Description of Artificial Sequence: Synthetic oligonucleotide
auggguaguuuuaaauaaa

SEQ ID NO: 893 - RNA, 19 nt, Artificial Sequence
  Description of Artificial Sequence: Synthetic oligonucleotide
uuauuuaaaacuacccaug

SEQ ID NO: 894 - RNA, 19 nt, Artificial Sequence
  Description of Artificial Sequence: Synthetic oligonucleotide
cauggguaguuuuaaauaa

SEQ ID NO: 895 - RNA, 19 nt, Artificial Sequence
  Description of Artificial Sequence: Synthetic oligonucleotide
auuuaaaacuacccaugca

SEQ ID NO: 896 - RNA, 19 nt, Artificial Sequence
  Description of Artificial Sequence: Synthetic oligonucleotide
ugcauggguaguuuuaaau

SEQ ID NO: 897 - RNA, 19 nt, Artificial Sequence
  Description of Artificial Sequence: Synthetic oligonucleotide
uuuaaaacuacccaugcaa

SEQ ID NO: 898 - RNA, 19 nt, Artificial Sequence
  Description of Artificial Sequence: Synthetic oligonucleotide
uugcauggguaguuuuaaa

SEQ ID NO: 899 - RNA, 19 nt, Artificial Sequence
  Description of Artificial Sequence: Synthetic oligonucleotide
aaaacuacccaugcaauua

SEQ ID NO: 900 - RNA, 19 nt, Artificial Sequence
  Description of Artificial Sequence: Synthetic oligonucleotide
uaauugcauggguaguuuu

SEQ ID NO: 901 - RNA, 19 nt, Artificial Sequence
  Description of Artificial Sequence: Synthetic oligonucleotide
cuacccaugcaauuaaaag

SEQ ID NO: 902 - RNA, 19 nt, Artificial Sequence
  Description of Artificial Sequence: Synthetic oligonucleotide
cuuuuaauugcauggguag

SEQ ID NO: 903 - RNA, 19 nt, Artificial Sequence
  Description of Artificial Sequence: Synthetic oligonucleotide
uacccaugcaauuaaaagg

SEQ ID NO: 904 - RNA, 19 nt, Artificial Sequence
  Description of Artificial Sequence: Synthetic oligonucleotide
ccuuuuaauugcaugggua

SEQ ID NO: 905 - RNA, 19 nt, Artificial Sequence
  Description of Artificial Sequence: Synthetic oligonucleotide
cccaugcaauuaaaaggua

SEQ ID NO: 906 - RNA, 19 nt, Artificial Sequence
  Description of Artificial Sequence: Synthetic oligonucleotide
uaccuuuuaauugcauggg

SEQ ID NO: 907 - RNA, 19 nt, Artificial Sequence
  Description of Artificial Sequence: Synthetic oligonucleotide
augcaauuaaaagguacaa

SEQ ID NO: 908 - RNA, 19 nt, Artificial Sequence
  Description of Artificial Sequence: Synthetic oligonucleotide
uuguaccuuuuaauugcau

SEQ ID NO: 909 - RNA, 19 nt, Artificial Sequence
  Description of Artificial Sequence: Synthetic oligonucleotide
ugcaauuaaaagguacaau

SEQ ID NO: 910 - RNA, 19 nt, Artificial Sequence
  Description of Artificial Sequence: Synthetic oligonucleotide
auuguaccuuuuaauugca

SEQ ID NO: 911 - RNA, 19 nt, Artificial Sequence
  Description of Artificial Sequence: Synthetic oligonucleotide
gcaauuaaaagguacaaug

SEQ ID NO: 912 - RNA, 19 nt, Artificial Sequence
  Description of Artificial Sequence: Synthetic oligonucleotide
cauuguaccuuuuaauugc

SEQ ID NO: 913 - RNA, 19 nt, Artificial Sequence
  Description of Artificial Sequence: Synthetic oligonucleotide
caauuaaaagguacaaugc

SEQ ID NO: 914 - RNA, 19 nt, Artificial Sequence
  Description of Artificial Sequence: Synthetic oligonucleotide
gcauuguaccuuuuaauug

SEQ ID NO: 915 - RNA, 19 nt, Artificial Sequence
  Description of Artificial Sequence: Synthetic oligonucleotide
gccaggcccugccgcucau

SEQ ID NO: 916 - RNA, 19 nt, Artificial Sequence
  Description of Artificial Sequence: Synthetic oligonucleotide
augagcggcagggccuggc

SEQ ID NO: 917 - RNA, 19 nt, Artificial Sequence
  Description of Artificial Sequence: Synthetic oligonucleotide
ccaggcccugccgcucaug

SEQ ID NO: 918 - RNA, 19 nt, Artificial Sequence
  Description of Artificial Sequence: Synthetic oligonucleotide
caugagcggcagggccugg

SEQ ID NO: 919 - RNA, 19 nt, Artificial Sequence
  Description of Artificial Sequence: Synthetic oligonucleotide
caggcccugccgcucaugg

SEQ ID NO: 920 - RNA, 19 nt, Artificial Sequence
  Description of Artificial Sequence: Synthetic oligonucleotide
ccaugagcggcagggccug

SEQ ID NO: 921 - RNA, 19 nt, Artificial Sequence
  Description of Artificial Sequence: Synthetic oligonucleotide
aggcccugccgcucauggu

SEQ ID NO: 922 - RNA, 19 nt, Artificial Sequence
  Description of Artificial Sequence: Synthetic oligonucleotide
accaugagcggcagggccu

SEQ ID NO: 923 - RNA, 19 nt, Artificial Sequence
  Description of Artificial Sequence: Synthetic oligonucleotide
ugccgcucauggugccagc

SEQ ID NO: 924 - RNA, 19 nt, Artificial Sequence
  Description of Artificial Sequence: Synthetic oligonucleotide
gcuggcaccaugagcggca

SEQ ID NO: 925 - RNA, 19 nt, Artificial Sequence
  Description of Artificial Sequence: Synthetic oligonucleotide
ccgcucauggugccagccc

SEQ ID NO: 926 - RNA, 19 nt, Artificial Sequence
  Description of Artificial Sequence: Synthetic oligonucleotide
gggcuggcaccaugagcgg

SEQ ID NO: 927 - RNA, 19 nt, Artificial Sequence
  Description of Artificial Sequence: Synthetic oligonucleotide
cgcucauggugccagccca

SEQ ID NO: 928 - RNA, 19 nt, Artificial Sequence
  Description of Artificial Sequence: Synthetic oligonucleotide
ugggcuggcaccaugagcg

SEQ ID NO: 929 - RNA, 19 nt, Artificial Sequence
  Description of Artificial Sequence: Synthetic oligonucleotide
gcucauggugccagcccag

SEQ ID NO: 930 - RNA, 19 nt, Artificial Sequence
  Description of Artificial Sequence: Synthetic oligonucleotide
cugggcuggcaccaugagc

SEQ ID NO: 931 - RNA, 19 nt, Artificial Sequence
  Description of Artificial Sequence: Synthetic oligonucleotide
gcccggaggcagcgagcgg

SEQ ID NO: 932 - DNA, 19 bp, Artificial Sequence
  Description of Combined DNA/RNA Molecule: Synthetic oligonucleotide
  Description of Artificial Sequence: Synthetic oligonucleotide
ccgctcgctgcctccgggc

SEQ ID NO: 933 - RNA, 19 nt, Artificial Sequence
  Description of Artificial Sequence: Synthetic oligonucleotide
cccggaggcagcgagcggg

SEQ ID NO: 934 - DNA, 19 bp, Artificial Sequence
  Description of Combined DNA/RNA Molecule: Synthetic oligonucleotide
  Description of Artificial Sequence: Synthetic oligonucleotide
cccgctcgctgcctccggg

SEQ ID NO: 935 - RNA, 19 nt, Artificial Sequence
  Description of Artificial Sequence: Synthetic oligonucleotide
ggcagcgagcggggggcug

SEQ ID NO: 936 - RNA, 19 nt, Artificial Sequence
  Description of Artificial Sequence: Synthetic oligonucleotide
cagccccccgcucgcugcc

SEQ ID NO: 937 - RNA, 19 nt, Artificial Sequence
  Description of Artificial Sequence: Synthetic oligonucleotide
gcagcgagcggggggcugc

SEQ ID NO: 938 - RNA, 19 nt, Artificial Sequence
  Description of Artificial Sequence: Synthetic oligonucleotide
gcagccccccgcucgcugc

SEQ ID NO: 939 - RNA, 19 nt, Artificial Sequence
  Description of Artificial Sequence: Synthetic oligonucleotide
cagcgagcggggggcugcc

SEQ ID NO: 940 - RNA, 19 nt, Artificial Sequence
  Description of Artificial Sequence: Synthetic oligonucleotide
ggcagccccccgcucgcug

SEQ ID NO: 941 - RNA, 19 nt, Artificial Sequence
  Description of Artificial Sequence: Synthetic oligonucleotide
agcgagcggggggcugccc

SEQ ID NO: 942 - RNA, 19 nt, Artificial Sequence
  Description of Artificial Sequence: Synthetic oligonucleotide
gggcagccccccgcucgcu

SEQ ID NO: 943 - RNA, 19 nt, Artificial Sequence
  Description of Artificial Sequence: Synthetic oligonucleotide
ggggggcugccccaggcgc

SEQ ID NO: 944 - RNA, 19 nt, Artificial Sequence
  Description of Artificial Sequence: Synthetic oligonucleotide
gcgccuggggcagcccccc

SEQ ID NO: 945 - RNA, 19 nt, Artificial Sequence
  Description of Artificial Sequence: Synthetic oligonucleotide
gggggcugccccaggcgcg

SEQ ID NO: 946 - RNA, 19 nt, Artificial Sequence
  Description of Artificial Sequence: Synthetic oligonucleotide
cgcgccuggggcagccccc

SEQ ID NO: 947 - RNA, 19 nt, Artificial Sequence
  Description of Artificial Sequence: Synthetic oligonucleotide
ggggcugccccaggcgcgc

SEQ ID NO: 948 - RNA, 19 nt, Artificial Sequence
  Description of Artificial Sequence: Synthetic oligonucleotide
gcgcgccuggggcagcccc

SEQ ID NO: 949 - RNA, 19 nt, Artificial Sequence
  Description of Artificial Sequence: Synthetic oligonucleotide
cugccccaggcgcgcaagc

SEQ ID NO: 950 - RNA, 19 nt, Artificial Sequence
  Description of Artificial Sequence: Synthetic oligonucleotide
gcuugcgcgccuggggcag

SEQ ID NO: 951 - RNA, 19 nt, Artificial Sequence
  Description of Artificial Sequence: Synthetic oligonucleotide
agccccgaggagaaggcgc

SEQ ID NO: 952 - DNA, 19 bp, Artificial Sequence
  Description of Combined DNA/RNA Molecule: Synthetic oligonucleotide
  Description of Artificial Sequence: Synthetic oligonucleotide
gcgccttctcctcggggct

SEQ ID NO: 953 - RNA, 19 nt, Artificial Sequence
  Description of Artificial Sequence: Synthetic oligonucleotide
gaggagaaggcgcugagga

SEQ ID NO: 954 - RNA, 19 nt, Artificial Sequence
  Description of Artificial Sequence: Synthetic oligonucleotide
uccucagcgccuucuccuc

SEQ ID NO: 955 - RNA, 19 nt, Artificial Sequence
  Description of Artificial Sequence: Synthetic oligonucleotide
aggcgcugaggaggaaacu

SEQ ID NO: 956 - RNA, 19 nt, Artificial Sequence
  Description of Artificial Sequence: Synthetic oligonucleotide
aguuuccuccucagcgccu

SEQ ID NO: 957 - RNA, 19 nt, Artificial Sequence
  Description of Artificial Sequence: Synthetic oligonucleotide
ggcgcugaggaggaaacug

SEQ ID NO: 958 - RNA, 19 nt, Artificial Sequence
  Description of Artificial Sequence: Synthetic oligonucleotide
caguuuccuccucagcgcc

SEQ ID NO: 959 - RNA, 19 nt, Artificial Sequence
  Description of Artificial Sequence: Synthetic oligonucleotide
aaacagaguagcagcucag

SEQ ID NO: 960 - RNA, 19 nt, Artificial Sequence
  Description of Artificial Sequence: Synthetic oligonucleotide
cugagcugcuacucuguuu

SEQ ID NO: 961 - RNA, 19 nt, Artificial Sequence
  Description of Artificial Sequence: Synthetic oligonucleotide
aacagaguagcagcucaga

SEQ ID NO: 962 - RNA, 19 nt, Artificial Sequence
  Description of Artificial Sequence: Synthetic oligonucleotide
ucugagcugcuacucuguu

SEQ ID NO: 963 - RNA, 19 nt, Artificial Sequence
  Description of Artificial Sequence: Synthetic oligonucleotide
acagaguagcagcucagac

SEQ ID NO: 964 - RNA, 19 nt, Artificial Sequence
  Description of Artificial Sequence: Synthetic oligonucleotide
gucugagcugcuacucugu

SEQ ID NO: 965 - RNA, 19 nt, Artificial Sequence
  Description of Artificial Sequence: Synthetic oligonucleotide
agcagcucagacugccaga

SEQ ID NO: 966 - RNA, 19 nt, Artificial Sequence
  Description of Artificial Sequence: Synthetic oligonucleotide
ucuggcagucugagcugcu

SEQ ID NO: 967 - RNA, 19 nt, Artificial Sequence
  Description of Artificial Sequence: Synthetic oligonucleotide
gcagcucagacugccagag

SEQ ID NO: 968 - RNA, 19 nt, Artificial Sequence
  Description of Artificial Sequence: Synthetic oligonucleotide
cucuggcagucugagcugc

SEQ ID NO: 969 - RNA, 19 nt, Artificial Sequence
  Description of Artificial Sequence: Synthetic oligonucleotide
cagcucagacugccagaga

SEQ ID NO: 970 - RNA, 19 nt, Artificial Sequence
  Description of Artificial Sequence: Synthetic oligonucleotide
ucucuggcagucugagcug

SEQ ID NO: 971 - RNA, 19 nt, Artificial Sequence
  Description of Artificial Sequence: Synthetic oligonucleotide
gcucagacugccagagauc

SEQ ID NO: 972 - RNA, 19 nt, Artificial Sequence
  Description of Artificial Sequence: Synthetic oligonucleotide
gaucucuggcagucugagc

SEQ ID NO: 973 - RNA, 19 nt, Artificial Sequence
  Description of Artificial Sequence: Synthetic oligonucleotide
gacugccagagaucgaaag

SEQ ID NO: 974 - RNA, 19 nt, Artificial Sequence
  Description of Artificial Sequence: Synthetic oligonucleotide
cuuucgaucucuggcaguc

SEQ ID NO: 975 - RNA, 19 nt, Artificial Sequence
  Description of Artificial Sequence: Synthetic oligonucleotide
ugagugagcuggaacagca

SEQ ID NO: 976 - RNA, 19 nt, Artificial Sequence
  Description of Artificial Sequence: Synthetic oligonucleotide
ugcuguuccagcucacuca

SEQ ID NO: 977 - RNA, 19 nt, Artificial Sequence
  Description of Artificial Sequence: Synthetic oligonucleotide
gcuggaacagcaaguggua

SEQ ID NO: 978 - RNA, 19 nt, Artificial Sequence
  Description of Artificial Sequence: Synthetic oligonucleotide
uaccacuugcuguuccagc

SEQ ID NO: 979 - RNA, 19 nt, Artificial Sequence
  Description of Artificial Sequence: Synthetic oligonucleotide
cuggaacagcaagugguag

SEQ ID NO: 980 - RNA, 19 nt, Artificial Sequence
  Description of Artificial Sequence: Synthetic oligonucleotide
cuaccacuugcuguuccag

SEQ ID NO: 981 - RNA, 19 nt, Artificial Sequence
  Description of Artificial Sequence: Synthetic oligonucleotide
acagcaagugguagauuua

SEQ ID NO: 982 - RNA, 19 nt, Artificial Sequence
  Description of Artificial Sequence: Synthetic oligonucleotide
uaaaucuaccacuugcugu

SEQ ID NO: 983 - RNA, 19 nt, Artificial Sequence
  Description of Artificial Sequence: Synthetic oligonucleotide
cagcaagugguagauuuag

SEQ ID NO: 984 - RNA, 19 nt, Artificial Sequence
  Description of Artificial Sequence: Synthetic oligonucleotide
cuaaaucuaccacuugcug

SEQ ID NO: 985 - RNA, 19 nt, Artificial Sequence
  Description of Artificial Sequence: Synthetic oligonucleotide
gcaagugguagauuuagaa

SEQ ID NO: 986 - RNA, 19 nt, Artificial Sequence
  Description of Artificial Sequence: Synthetic oligonucleotide
uucuaaaucuaccacuugc

SEQ ID NO: 987 - RNA, 19 nt, Artificial Sequence
  Description of Artificial Sequence: Synthetic oligonucleotide
caagugguagauuuagaag

SEQ ID NO: 988 - RNA, 19 nt, Artificial Sequence
  Description of Artificial Sequence: Synthetic oligonucleotide
cuucuaaaucuaccacuug

SEQ ID NO: 989 - RNA, 19 nt, Artificial Sequence
  Description of Artificial Sequence: Synthetic oligonucleotide
gugguagauuuagaagaag

SEQ ID NO: 990 - RNA, 19 nt, Artificial Sequence
  Description of Artificial Sequence: Synthetic oligonucleotide
cuucuucuaaaucuaccac

SEQ ID NO: 991 - RNA, 19 nt, Artificial Sequence
  Description of Artificial Sequence: Synthetic oligonucleotide
ugguagauuuagaagaaga

SEQ ID NO: 992 - RNA, 19 nt, Artificial Sequence
  Description of Artificial Sequence: Synthetic oligonucleotide
ucuucuucuaaaucuacca

SEQ ID NO: 993 - RNA, 19 nt, Artificial Sequence
  Description of Artificial Sequence: Synthetic oligonucleotide
gguagauuuagaagaagag

SEQ ID NO: 994 - RNA, 19 nt, Artificial Sequence
  Description of Artificial Sequence: Synthetic oligonucleotide
cucuucuucuaaaucuacc

SEQ ID NO: 995 - RNA, 19 nt, Artificial Sequence
  Description of Artificial Sequence: Synthetic oligonucleotide
guagauuuagaagaagaga

SEQ ID NO: 996 - RNA, 19 nt, Artificial Sequence
  Description of Artificial Sequence: Synthetic oligonucleotide
ucucuucuucuaaaucuac

SEQ ID NO: 997 - RNA, 19 nt, Artificial Sequence
  Description of Artificial Sequence: Synthetic oligonucleotide
uuagaagaagagaaccaaa

SEQ ID NO: 998 - RNA, 19 nt, Artificial Sequence
  Description of Artificial Sequence: Synthetic oligonucleotide
uuugguucucuucuucuaa

SEQ ID NO: 999 - RNA, 19 nt, Artificial Sequence
  Description of Artificial Sequence: Synthetic oligonucleotide
agaagagaaccaaaaacuu

SEQ ID NO: 1000 - RNA, 19 nt, Artificial Sequence
  Description of Artificial Sequence: Synthetic oligonucleotide
aaguuuuugguucucuucu

SEQ ID NO: 1001 - RNA, 19 nt, Artificial Sequence
  Description of Artificial Sequence: Synthetic oligonucleotide
agagaaccaaaaacuuuug

SEQ ID NO: 1002 - RNA, 19 nt, Artificial Sequence
  Description of Artificial Sequence: Synthetic oligonucleotide
caaaaguuuuugguucucu

SEQ ID NO: 1003 - RNA, 19 nt, Artificial Sequence
  Description of Artificial Sequence: Synthetic oligonucleotide
gagaaccaaaaacuuuugc

SEQ ID NO: 1004 - RNA, 19 nt, Artificial Sequence
  Description of Artificial Sequence: Synthetic oligonucleotide
gcaaaaguuuuugguucuc

SEQ ID NO: 1005 - RNA, 19 nt, Artificial Sequence
  Description of Artificial Sequence: Synthetic oligonucleotide
gaaccaaaaacuuuugcua

SEQ ID NO: 1006 - RNA, 19 nt, Artificial Sequence
  Description of Artificial Sequence: Synthetic oligonucleotide
uagcaaaaguuuuugguuc

SEQ ID NO: 1007 - RNA, 19 nt, Artificial Sequence
  Description of Artificial Sequence: Synthetic oligonucleotide
caaaaacuuuugcuagaaa

SEQ ID NO: 1008 - RNA, 19 nt, Artificial Sequence
  Description of Artificial Sequence: Synthetic oligonucleotide
uuucuagcaaaaguuuuug

SEQ ID NO: 1009 - RNA, 19 nt, Artificial Sequence
  Description of Artificial Sequence: Synthetic oligonucleotide
acuuuugcuagaaaaucag

SEQ ID NO: 1010 - RNA, 19 nt, Artificial Sequence
  Description of Artificial Sequence: Synthetic oligonucleotide
cugauuuucuagcaaaagu

SEQ ID NO: 1011 - RNA, 19 nt, Artificial Sequence
  Description of Artificial Sequence: Synthetic oligonucleotide
uuugcuagaaaaucagcuu

SEQ ID NO: 1012 - RNA, 19 nt, Artificial Sequence
  Description of Artificial Sequence: Synthetic oligonucleotide
aagcugauuuucuagcaaa

SEQ ID NO: 1013 - RNA, 19 nt, Artificial Sequence
  Description of Artificial Sequence: Synthetic oligonucleotide
cuagaaaaucagcuuuuac

SEQ ID NO: 1014 - RNA, 19 nt, Artificial Sequence
  Description of Artificial Sequence: Synthetic oligonucleotide
guaaaagcugauuuucuag

SEQ ID NO: 1015 - RNA, 19 nt, Artificial Sequence
  Description of Artificial Sequence: Synthetic oligonucleotide
aaaaucagcuuuuacgaga

SEQ ID NO: 1016 - RNA, 19 nt, Artificial Sequence
  Description of Artificial Sequence: Synthetic oligonucleotide
ucucguaaaagcugauuuu

SEQ ID NO: 1017 - RNA, 19 nt, Artificial Sequence
  Description of Artificial Sequence: Synthetic oligonucleotide
aaucagcuuuuacgagaga

SEQ ID NO: 1018 - RNA, 19 nt, Artificial Sequence
  Description of Artificial Sequence: Synthetic oligonucleotide
ucucucguaaaagcugauu

SEQ ID NO: 1019 - RNA, 19 nt, Artificial Sequence
  Description of Artificial Sequence: Synthetic oligonucleotide
ucagcuuuuacgagagaaa

SEQ ID NO: 1020 - RNA, 19 nt, Artificial Sequence
  Description of Artificial Sequence: Synthetic oligonucleotide
uuucucucguaaaagcuga

SEQ ID NO: 1021 - RNA, 19 nt, Artificial Sequence
  Description of Artificial Sequence: Synthetic oligonucleotide
cuuuuacgagagaaaacuc

SEQ ID NO: 1022 - RNA, 19 nt, Artificial Sequence
  Description of Artificial Sequence: Synthetic oligonucleotide
gaguuuucucucguaaaag

SEQ ID NO: 1023 - RNA, 19 nt, Artificial Sequence
  Description of Artificial Sequence: Synthetic oligonucleotide
ggccuuguaguugagaacc

SEQ ID NO: 1024 - RNA, 19 nt, Artificial Sequence
  Description of Artificial Sequence: Synthetic oligonucleotide
gguucucaacuacaaggcc

SEQ ID NO: 1025 - RNA, 19 nt, Artificial Sequence
  Description of Artificial Sequence: Synthetic oligonucleotide
gccuuguaguugagaacca

SEQ ID NO: 1026 - RNA, 19 nt, Artificial Sequence
  Description of Artificial Sequence: Synthetic oligonucleotide
ugguucucaacuacaaggc

SEQ ID NO: 1027 - RNA, 19 nt, Artificial Sequence
  Description of Artificial Sequence: Synthetic oligonucleotide
ccuuguaguugagaaccag

SEQ ID NO: 1028 - RNA, 19 nt, Artificial Sequence
  Description of Artificial Sequence: Synthetic oligonucleotide
cugguucucaacuacaagg

SEQ ID NO: 1029 - RNA, 19 nt, Artificial Sequence
  Description of Artificial Sequence: Synthetic oligonucleotide
uuguaguugagaaccagga

SEQ ID NO: 1030 - RNA, 19 nt, Artificial Sequence
  Description of Artificial Sequence: Synthetic oligonucleotide
uccugguucucaacuacaa

SEQ ID NO: 1031 - RNA, 19 nt, Artificial Sequence
  Description of Artificial Sequence: Synthetic oligonucleotide
uaguugagaaccaggaguu

SEQ ID NO: 1032 - RNA, 19 nt, Artificial Sequence
  Description of Artificial Sequence: Synthetic oligonucleotide
aacuccugguucucaacua

SEQ ID NO: 1033 - RNA, 19 nt, Artificial Sequence
  Description of Artificial Sequence: Synthetic oligonucleotide
aguugagaaccaggaguua

SEQ ID NO: 1034 - RNA, 19 nt, Artificial Sequence
  Description of Artificial Sequence: Synthetic oligonucleotide
uaacuccugguucucaacu

SEQ ID NO: 1035 - RNA, 19 nt, Artificial Sequence
  Description of Artificial Sequence: Synthetic oligonucleotide
ugagaaccaggaguuaaga

SEQ ID NO: 1036 - RNA, 19 nt, Artificial Sequence
  Description of Artificial Sequence: Synthetic oligonucleotide
ucuuaacuccugguucuca

SEQ ID NO: 1037 - RNA, 19 nt, Artificial Sequence
  Description of Artificial Sequence: Synthetic oligonucleotide
gagaaccaggaguuaagac

SEQ ID NO: 1038 - RNA, 19 nt, Artificial Sequence
  Description of Artificial Sequence: Synthetic oligonucleotide
gucuuaacuccugguucuc

SEQ ID NO: 1039 - RNA, 19 nt, Artificial Sequence
  Description of Artificial Sequence: Synthetic oligonucleotide
agaaccaggaguuaagaca

SEQ ID NO: 1040 - RNA, 19 nt, Artificial Sequence
  Description of Artificial Sequence: Synthetic oligonucleotide
ugucuuaacuccugguucu

SEQ ID NO: 1041 - RNA, 19 nt, Artificial Sequence
  Description of Artificial Sequence: Synthetic oligonucleotide
gaaccaggaguuaagacag

SEQ ID NO: 1042 - RNA, 19 nt, Artificial Sequence
  Description of Artificial Sequence: Synthetic oligonucleotide
cugucuuaacuccugguuc

SEQ ID NO: 1043 - RNA, 19 nt, Artificial Sequence
  Description of Artificial Sequence: Synthetic oligonucleotide
aaccaggaguuaagacagc

SEQ ID NO: 1044 - RNA, 19 nt, Artificial Sequence
  Description of Artificial Sequence: Synthetic oligonucleotide
gcugucuuaacuccugguu

SEQ ID NO: 1045 - RNA, 19 nt, Artificial Sequence
  Description of Artificial Sequence: Synthetic oligonucleotide
ggggauggaugcccugguu

SEQ ID NO: 1046 - RNA, 19 nt, Artificial Sequence
  Description of Artificial Sequence: Synthetic oligonucleotide
aaccagggcauccaucccc

SEQ ID NO: 1047 - RNA, 19 nt, Artificial Sequence
  Description of Artificial Sequence: Synthetic oligonucleotide
gggauggaugcccugguug

SEQ ID NO: 1048 - RNA, 19 nt, Artificial Sequence
  Description of Artificial Sequence: Synthetic oligonucleotide
caaccagggcauccauccc

SEQ ID NO: 1049 - RNA, 19 nt, Artificial Sequence
  Description of Artificial Sequence: Synthetic oligonucleotide
gauggaugcccugguugcu

SEQ ID NO: 1050 - RNA, 19 nt, Artificial Sequence
  Description of Artificial Sequence: Synthetic oligonucleotide
agcaaccagggcauccauc

SEQ ID NO: 1051 - RNA, 19 nt, Artificial Sequence
  Description of Artificial Sequence: Synthetic oligonucleotide
ggaggcggaagccaagggg

SEQ ID NO: 1052 - DNA, 19 bp, Artificial Sequence
  Description of Combined DNA/RNA Molecule: Synthetic oligonucleotide
  Description of Artificial Sequence: Synthetic oligonucleotide
ccccttggcttccgcctcc

SEQ ID NO: 1053 - RNA, 19 nt, Artificial Sequence
  Description of Artificial Sequence: Synthetic oligonucleotide
agugaggccaguggccggg

SEQ ID NO: 1054 - RNA, 19 nt, Artificial Sequence
  Description of Artificial Sequence: Synthetic oligonucleotide
cccggccacuggccucacu

SEQ ID NO: 1055 - RNA, 19 nt, Artificial Sequence
  Description of Artificial Sequence: Synthetic oligonucleotide
gaggccaguggccgggucu

SEQ ID NO: 1056 - RNA, 19 nt, Artificial Sequence
  Description of Artificial Sequence: Synthetic oligonucleotide
agacccggccacuggccuc

SEQ ID NO: 1057 - RNA, 19 nt, Artificial Sequence
  Description of Artificial Sequence: Synthetic oligonucleotide
aggccaguggccgggucug

SEQ ID NO: 1058 - RNA, 19 nt, Artificial Sequence
  Description of Artificial Sequence: Synthetic oligonucleotide
cagacccggccacuggccu

SEQ ID NO: 1059 - RNA, 19 nt, Artificial Sequence
  Description of Artificial Sequence: Synthetic oligonucleotide
ggccaguggccgggucugc

SEQ ID NO: 1060 - RNA, 19 nt, Artificial Sequence
  Description of Artificial Sequence: Synthetic oligonucleotide
gcagacccggccacuggcc

SEQ ID NO: 1061 - RNA, 19 nt, Artificial Sequence
  Description of Artificial Sequence: Synthetic oligonucleotide
gccaguggccgggucugcu

SEQ ID NO: 1062 - RNA, 19 nt, Artificial Sequence
  Description of Artificial Sequence: Synthetic oligonucleotide
agcagacccggccacuggc

SEQ ID NO: 1063 - RNA, 19 nt, Artificial Sequence
  Description of Artificial Sequence: Synthetic oligonucleotide
guggccgggucugcugagu

SEQ ID NO: 1064 - RNA, 19 nt, Artificial Sequence
  Description of Artificial Sequence: Synthetic oligonucleotide
acucagcagacccggccac

SEQ ID NO: 1065 - RNA, 19 nt, Artificial Sequence
  Description of Artificial Sequence: Synthetic oligonucleotide
uggccgggucugcugaguc

SEQ ID NO: 1066 - RNA, 19 nt, Artificial Sequence
  Description of Artificial Sequence: Synthetic oligonucleotide
gacucagcagacccggcca

SEQ ID NO: 1067 - RNA, 19 nt, Artificial Sequence
  Description of Artificial Sequence: Synthetic oligonucleotide
gccgggucugcugaguccg

SEQ ID NO: 1068 - RNA, 19 nt, Artificial Sequence
  Description of Artificial Sequence: Synthetic oligonucleotide
cggacucagcagacccggc

SEQ ID NO: 1069 - RNA, 19 nt, Artificial Sequence
  Description of Artificial Sequence: Synthetic oligonucleotide
aggcccaguugucaccccu

SEQ ID NO: 1070 - RNA, 19 nt, Artificial Sequence
  Description of Artificial Sequence: Synthetic oligonucleotide
aggggugacaacugggccu

SEQ ID NO: 1071 - RNA, 19 nt, Artificial Sequence
  Description of Artificial Sequence: Synthetic oligonucleotide
cccaguugucaccccucca

SEQ ID NO: 1072 - RNA, 19 nt, Artificial Sequence
  Description of Artificial Sequence: Synthetic oligonucleotide
uggaggggugacaacuggg

SEQ ID NO: 1073 - RNA, 19 nt, Artificial Sequence
  Description of Artificial Sequence: Synthetic oligonucleotide
ccaguugucaccccuccag

SEQ ID NO: 1074 - RNA, 19 nt, Artificial Sequence
  Description of Artificial Sequence: Synthetic oligonucleotide
cuggaggggugacaacugg

SEQ ID NO: 1075 - RNA, 19 nt, Artificial Sequence
  Description of Artificial Sequence: Synthetic oligonucleotide
caguugucaccccuccaga

SEQ ID NO: 1076 - RNA, 19 nt, Artificial Sequence
  Description of Artificial Sequence: Synthetic oligonucleotide
ucuggaggggugacaacug

SEQ ID NO: 1077 - RNA, 19 nt, Artificial Sequence
  Description of Artificial Sequence: Synthetic oligonucleotide
aguugucaccccuccagaa

SEQ ID NO: 1078 - RNA, 19 nt, Artificial Sequence
  Description of Artificial Sequence: Synthetic oligonucleotide
uucuggaggggugacaacu

SEQ ID NO: 1079 - RNA, 19 nt, Artificial Sequence
  Description of Artificial Sequence: Synthetic oligonucleotide
guugucaccccuccagaac

SEQ ID NO: 1080 - RNA, 19 nt, Artificial Sequence
  Description of Artificial Sequence: Synthetic oligonucleotide
guucuggaggggugacaac

SEQ ID NO: 1081 - RNA, 19 nt, Artificial Sequence
  Description of Artificial Sequence: Synthetic oligonucleotide
uugucaccccuccagaaca

SEQ ID NO: 1082 - RNA, 19 nt, Artificial Sequence
  Description of Artificial Sequence: Synthetic oligonucleotide
uguucuggaggggugacaa

SEQ ID NO: 1083 - RNA, 19 nt, Artificial Sequence
  Description of Artificial Sequence: Synthetic oligonucleotide
ugucaccccuccagaacau

SEQ ID NO: 1084 - RNA, 19 nt, Artificial Sequence
  Description of Artificial Sequence: Synthetic oligonucleotide
auguucuggaggggugaca

SEQ ID NO: 1085 - RNA, 19 nt, Artificial Sequence
  Description of Artificial Sequence: Synthetic oligonucleotide
gucaccccuccagaacauc

SEQ ID NO: 1086 - RNA, 19 nt, Artificial Sequence
  Description of Artificial Sequence: Synthetic oligonucleotide
gauguucuggaggggugac

SEQ ID NO: 1087 - RNA, 19 nt, Artificial Sequence
  Description of Artificial Sequence: Synthetic oligonucleotide
ucaccccuccagaacaucu

SEQ ID NO: 1088 - RNA, 19 nt, Artificial Sequence
  Description of Artificial Sequence: Synthetic oligonucleotide
agauguucuggagggguga

SEQ ID NO: 1089 - RNA, 19 nt, Artificial Sequence
  Description of Artificial Sequence: Synthetic oligonucleotide
caccccuccagaacaucuc

SEQ ID NO: 1090 - RNA, 19 nt, Artificial Sequence
  Description of Artificial Sequence: Synthetic oligonucleotide
gagauguucuggaggggug

SEQ ID NO: 1091 - RNA, 19 nt, Artificial Sequence
  Description of Artificial Sequence: Synthetic oligonucleotide
accccuccagaacaucucc

SEQ ID NO: 1092 - RNA, 19 nt, Artificial Sequence
  Description of Artificial Sequence: Synthetic oligonucleotide
ggagauguucuggaggggu

SEQ ID NO: 1093 - RNA, 19 nt, Artificial Sequence
  Description of Artificial Sequence: Synthetic oligonucleotide
ccagaacaucuccccaugg

SEQ ID NO: 1094 - RNA, 19 nt, Artificial Sequence
  Description of Artificial Sequence: Synthetic oligonucleotide
ccauggggagauguucugg

SEQ ID NO: 1095 - RNA, 19 nt, Artificial Sequence
  Description of Artificial Sequence: Synthetic oligonucleotide
gaacaucuccccauggauu

SEQ ID NO: 1096 - RNA, 19 nt, Artificial Sequence
  Description of Artificial Sequence: Synthetic oligonucleotide
aauccauggggagauguuc

SEQ ID NO: 1097 - RNA, 19 nt, Artificial Sequence
  Description of Artificial Sequence: Synthetic oligonucleotide
caucuccccauggauucug

SEQ ID NO: 1098 - RNA, 19 nt, Artificial Sequence
  Description of Artificial Sequence: Synthetic oligonucleotide
cagaauccauggggagaug

SEQ ID NO: 1099 - RNA, 19 nt, Artificial Sequence
  Description of Artificial Sequence: Synthetic oligonucleotide
cuggcgguauugacucuuc

SEQ ID NO: 1100 - RNA, 19 nt, Artificial Sequence
  Description of Artificial Sequence: Synthetic oligonucleotide
gaagagucaauaccgccag

SEQ ID NO: 1101 - RNA, 19 nt, Artificial Sequence
  Description of Artificial Sequence: Synthetic oligonucleotide
uggcgguauugacucuuca

SEQ ID NO: 1102 - RNA, 19 nt, Artificial Sequence
  Description of Artificial Sequence: Synthetic oligonucleotide
ugaagagucaauaccgcca

SEQ ID NO: 1103 - RNA, 19 nt, Artificial Sequence
  Description of Artificial Sequence: Synthetic oligonucleotide
gcgguauugacucuucaga

SEQ ID NO: 1104 - RNA, 19 nt, Artificial Sequence
  Description of Artificial Sequence: Synthetic oligonucleotide
ucugaagagucaauaccgc

SEQ ID NO: 1105 - RNA, 19 nt, Artificial Sequence
  Description of Artificial Sequence: Synthetic oligonucleotide
cgguauugacucuucagau

SEQ ID NO: 1106 - RNA, 19 nt, Artificial Sequence
  Description of Artificial Sequence: Synthetic oligonucleotide
aucugaagagucaauaccg

SEQ ID NO: 1107 - RNA, 19 nt, Artificial Sequence
  Description of Artificial Sequence: Synthetic oligonucleotide
gguauugacucuucagauu

SEQ ID NO: 1108 - RNA, 19 nt, Artificial Sequence
  Description of Artificial Sequence: Synthetic oligonucleotide
aaucugaagagucaauacc

SEQ ID NO: 1109 - RNA, 19 nt, Artificial Sequence
  Description of Artificial Sequence: Synthetic oligonucleotide
guauugacucuucagauuc

SEQ ID NO: 1110 - RNA, 19 nt, Artificial Sequence
  Description of Artificial Sequence: Synthetic oligonucleotide
gaaucugaagagucaauac

SEQ ID NO: 1111 - RNA, 19 nt, Artificial Sequence
  Description of Artificial Sequence: Synthetic oligonucleotide
uauugacucuucagauuca

SEQ ID NO: 1112 - RNA, 19 nt, Artificial Sequence
  Description of Artificial Sequence: Synthetic oligonucleotide
ugaaucugaagagucaaua

SEQ ID NO: 1113 - RNA, 19 nt, Artificial Sequence
  Description of Artificial Sequence: Synthetic oligonucleotide
ugacucuucagauucagag

SEQ ID NO: 1114 - RNA, 19 nt, Artificial Sequence
  Description of Artificial Sequence: Synthetic oligonucleotide
cucugaaucugaagaguca

SEQ ID NO: 1115 - RNA, 19 nt, Artificial Sequence
  Description of Artificial Sequence: Synthetic oligonucleotide
cucuucagauucagagucu

SEQ ID NO: 1116 - RNA, 19 nt, Artificial Sequence
  Description of Artificial Sequence: Synthetic oligonucleotide
agacucugaaucugaagag

SEQ ID NO: 1117 - RNA, 19 nt, Artificial Sequence
  Description of Artificial Sequence: Synthetic oligonucleotide
cuucagauucagagucuga

SEQ ID NO: 1118 - RNA, 19 nt, Artificial Sequence
  Description of Artificial Sequence: Synthetic oligonucleotide
ucagacucugaaucugaag

SEQ ID NO: 1119 - RNA, 19 nt, Artificial Sequence
  Description of Artificial Sequence: Synthetic oligonucleotide
cagauucagagucugauau

SEQ ID NO: 1120 - RNA, 19 nt, Artificial Sequence
  Description of Artificial Sequence: Synthetic oligonucleotide
auaucagacucugaaucug

SEQ ID NO: 1121 - RNA, 19 nt, Artificial Sequence
  Description of Artificial Sequence: Synthetic oligonucleotide
agauucagagucugauauc

SEQ ID NO: 1122 - RNA, 19 nt, Artificial Sequence
  Description of Artificial Sequence: Synthetic oligonucleotide
gauaucagacucugaaucu

SEQ ID NO: 1123 - RNA, 19 nt, Artificial Sequence
  Description of Artificial Sequence: Synthetic oligonucleotide
gauucagagucugauaucc

SEQ ID NO: 1124 - RNA, 19 nt, Artificial Sequence
  Description of Artificial Sequence: Synthetic oligonucleotide
ggauaucagacucugaauc

SEQ ID NO: 1125 - RNA, 19 nt, Artificial Sequence
  Description of Artificial Sequence: Synthetic oligonucleotide
ucagagucugauauccugu

SEQ ID NO: 1126 - RNA, 19 nt, Artificial Sequence
  Description of Artificial Sequence: Synthetic oligonucleotide
acaggauaucagacucuga

SEQ ID NO: 1127 - RNA, 19 nt, Artificial Sequence
  Description of Artificial Sequence: Synthetic oligonucleotide
cagagucugauauccuguu

SEQ ID NO: 1128 - RNA, 19 nt, Artificial Sequence
  Description of Artificial Sequence: Synthetic oligonucleotide
aacaggauaucagacucug

SEQ ID NO: 1129 - RNA, 19 nt, Artificial Sequence
  Description of Artificial Sequence: Synthetic oligonucleotide
agagucugauauccuguug

SEQ ID NO: 1130 - RNA, 19 nt, Artificial Sequence
  Description of Artificial Sequence: Synthetic oligonucleotide
caacaggauaucagacucu

SEQ ID NO: 1131 - RNA, 19 nt, Artificial Sequence
  Description of Artificial Sequence: Synthetic oligonucleotide
agucugauauccuguuggg

SEQ ID NO: 1132 - RNA, 19 nt, Artificial Sequence
  Description of Artificial Sequence: Synthetic oligonucleotide
cccaacaggauaucagacu

SEQ ID NO: 1133 - RNA, 19 nt, Artificial Sequence
  Description of Artificial Sequence: Synthetic oligonucleotide
cugauauccuguugggcau

SEQ ID NO: 1134 - RNA, 19 nt, Artificial Sequence
  Description of Artificial Sequence: Synthetic oligonucleotide
augcccaacaggauaucag

SEQ ID NO: 1135 - RNA, 19 nt, Artificial Sequence
  Description of Artificial Sequence: Synthetic oligonucleotide
ugauauccuguugggcauu

SEQ ID NO: 1136 - RNA, 19 nt, Artificial Sequence
  Description of Artificial Sequence: Synthetic oligonucleotide
aaugcccaacaggauauca

SEQ ID NO: 1137 - RNA, 19 nt, Artificial Sequence
  Description of Artificial Sequence: Synthetic oligonucleotide
uauccuguugggcauucug

SEQ ID NO: 1138 - RNA, 19 nt, Artificial Sequence
  Description of Artificial Sequence: Synthetic oligonucleotide
cagaaugcccaacaggaua

SEQ ID NO: 1139 - RNA, 19 nt, Artificial Sequence
  Description of Artificial Sequence: Synthetic oligonucleotide
uguugggcauucuggacaa

SEQ ID NO: 1140 - RNA, 19 nt, Artificial Sequence
  Description of Artificial Sequence: Synthetic oligonucleotide
uuguccagaaugcccaaca

SEQ ID NO: 1141 - RNA, 19 nt, Artificial Sequence
  Description of Artificial Sequence: Synthetic oligonucleotide
guugggcauucuggacaac

SEQ ID NO: 1142 - RNA, 19 nt, Artificial Sequence
  Description of Artificial Sequence: Synthetic oligonucleotide
guuguccagaaugcccaac

SEQ ID NO: 1143 - RNA, 19 nt, Artificial Sequence
  Description of Artificial Sequence: Synthetic oligonucleotide
uugggcauucuggacaacu

SEQ ID NO: 1144 - RNA, 19 nt, Artificial Sequence
  Description of Artificial Sequence: Synthetic oligonucleotide
aguuguccagaaugcccaa

SEQ ID NO: 1145 - RNA, 19 nt, Artificial Sequence
  Description of Artificial Sequence: Synthetic oligonucleotide
ggcauucuggacaacuugg

SEQ ID NO: 1146 - RNA, 19 nt, Artificial Sequence
  Description of Artificial Sequence: Synthetic oligonucleotide
ccaaguuguccagaaugcc

SEQ ID NO: 1147 - RNA, 19 nt, Artificial Sequence
  Description of Artificial Sequence: Synthetic oligonucleotide
gcauucuggacaacuugga

SEQ ID NO: 1148 - RNA, 19 nt, Artificial Sequence
  Description of Artificial Sequence: Synthetic oligonucleotide
uccaaguuguccagaaugc

SEQ ID NO: 1149 - RNA, 19 nt, Artificial Sequence
  Description of Artificial Sequence: Synthetic oligonucleotide
ucuggacaacuuggaccca

SEQ ID NO: 1150 - RNA, 19 nt, Artificial Sequence
  Description of Artificial Sequence: Synthetic oligonucleotide
uggguccaaguuguccaga

SEQ ID NO: 1151 - RNA, 19 nt, Artificial Sequence
  Description of Artificial Sequence: Synthetic oligonucleotide
ggacaacuuggacccaguc

SEQ ID NO: 1152 - RNA, 19 nt, Artificial Sequence
  Description of Artificial Sequence: Synthetic oligonucleotide
gacuggguccaaguugucc

SEQ ID NO: 1153 - RNA, 19 nt, Artificial Sequence
  Description of Artificial Sequence: Synthetic oligonucleotide
acuuggacccagucauguu

SEQ ID NO: 1154 - RNA, 19 nt, Artificial Sequence
  Description of Artificial Sequence: Synthetic oligonucleotide
aacaugacuggguccaagu

SEQ ID NO: 1155 - RNA, 19 nt, Artificial Sequence
  Description of Artificial Sequence: Synthetic oligonucleotide
cuuggacccagucauguuc

SEQ ID NO: 1156 - RNA, 19 nt, Artificial Sequence
  Description of Artificial Sequence: Synthetic oligonucleotide
gaacaugacuggguccaag

SEQ ID NO: 1157 - RNA, 19 nt, Artificial Sequence
  Description of Artificial Sequence: Synthetic oligonucleotide
uggacccagucauguucuu

SEQ ID NO: 1158 - RNA, 19 nt, Artificial Sequence
  Description of Artificial Sequence: Synthetic oligonucleotide
aagaacaugacugggucca

SEQ ID NO: 1159 - RNA, 19 nt, Artificial Sequence
  Description of Artificial Sequence: Synthetic oligonucleotide
ggacccagucauguucuuc

SEQ ID NO: 1160 - RNA, 19 nt, Artificial Sequence
  Description of Artificial Sequence: Synthetic oligonucleotide
gaagaacaugacugggucc

SEQ ID NO: 1161 - RNA, 19 nt, Artificial Sequence
  Description of Artificial Sequence: Synthetic oligonucleotide
acccagucauguucuucaa

SEQ ID NO: 1162 - RNA, 19 nt, Artificial Sequence
  Description of Artificial Sequence: Synthetic oligonucleotide
uugaagaacaugacugggu

SEQ ID NO: 1163 - RNA, 19 nt, Artificial Sequence
  Description of Artificial Sequence: Synthetic oligonucleotide
gucauguucuucaaaugcc

SEQ ID NO: 1164 - RNA, 19 nt, Artificial Sequence
  Description of Artificial Sequence: Synthetic oligonucleotide
ggcauuugaagaacaugac

SEQ ID NO: 1165 - RNA, 19 nt, Artificial Sequence
  Description of Artificial Sequence: Synthetic oligonucleotide
cauguucuucaaaugcccu

SEQ ID NO: 1166 - RNA, 19 nt, Artificial Sequence
  Description of Artificial Sequence: Synthetic oligonucleotide
agggcauuugaagaacaug

SEQ ID NO: 1167 - RNA, 19 nt, Artificial Sequence
  Description of Artificial Sequence: Synthetic oligonucleotide
cuucaaaugcccuucccca

SEQ ID NO: 1168 - RNA, 19 nt, Artificial Sequence
  Description of Artificial Sequence: Synthetic oligonucleotide
uggggaagggcauuugaag

SEQ ID NO: 1169 - RNA, 19 nt, Artificial Sequence
  Description of Artificial Sequence: Synthetic oligonucleotide
uucaaaugcccuuccccag

SEQ ID NO: 1170 - RNA, 19 nt, Artificial Sequence
  Description of Artificial Sequence: Synthetic oligonucleotide
cuggggaagggcauuugaa

SEQ ID NO: 1171 - RNA, 19 nt, Artificial Sequence
  Description of Artificial Sequence: Synthetic oligonucleotide
caaaugcccuuccccagag

SEQ ID NO: 1172 - RNA, 19 nt, Artificial Sequence
  Description of Artificial Sequence: Synthetic oligonucleotide
cucuggggaagggcauuug

SEQ ID NO: 1173 - RNA, 19 nt, Artificial Sequence
  Description of Artificial Sequence: Synthetic oligonucleotide
ggagcucccagaggucuac

SEQ ID NO: 1174 - RNA, 19 nt, Artificial Sequence
  Description of Artificial Sequence: Synthetic oligonucleotide
guagaccucugggagcucc

SEQ ID NO: 1175 - RNA, 19 nt, Artificial Sequence
  Description of Artificial Sequence: Synthetic oligonucleotide
gagcucccagaggucuacc

SEQ ID NO: 1176 - RNA, 19 nt, Artificial Sequence
  Description of Artificial Sequence: Synthetic oligonucleotide
gguagaccucugggagcuc

SEQ ID NO: 1177 - RNA, 19 nt, Artificial Sequence
  Description of Artificial Sequence: Synthetic oligonucleotide
agcucccagaggucuaccc

SEQ ID NO: 1178 - RNA, 19 nt, Artificial Sequence
  Description of Artificial Sequence: Synthetic oligonucleotide
ggguagaccucugggagcu

SEQ ID NO: 1179 - RNA, 19 nt, Artificial Sequence
  Description of Artificial Sequence: Synthetic oligonucleotide
ucccagaggucuacccaga

SEQ ID NO: 1180 - RNA, 19 nt, Artificial Sequence
  Description of Artificial Sequence: Synthetic oligonucleotide
ucuggguagaccucuggga

SEQ ID NO: 1181 - RNA, 19 nt, Artificial Sequence
  Description of Artificial Sequence: Synthetic oligonucleotide
cccagaggucuacccagaa

SEQ ID NO: 1182 - RNA, 19 nt, Artificial Sequence
  Description of Artificial Sequence: Synthetic oligonucleotide
uucuggguagaccucuggg

SEQ ID NO: 1183 - RNA, 19 nt, Artificial Sequence
  Description of Artificial Sequence: Synthetic oligonucleotide
ccagaggucuacccagaag

SEQ ID NO: 1184 - RNA, 19 nt, Artificial Sequence
  Description of Artificial Sequence: Synthetic oligonucleotide
cuucuggguagaccucugg

SEQ ID NO: 1185 - RNA, 19 nt, Artificial Sequence
  Description of Artificial Sequence: Synthetic oligonucleotide
agaggucuacccagaagga

SEQ ID NO: 1186 - RNA, 19 nt, Artificial Sequence
  Description of Artificial Sequence: Synthetic oligonucleotide
uccuucuggguagaccucu

SEQ ID NO: 1187 - RNA, 19 nt, Artificial Sequence
  Description of Artificial Sequence: Synthetic oligonucleotide
gaggucuacccagaaggac

SEQ ID NO: 1188 - RNA, 19 nt, Artificial Sequence
  Description of Artificial Sequence: Synthetic oligonucleotide
guccuucuggguagaccuc

SEQ ID NO: 1189 - RNA, 19 nt, Artificial Sequence
  Description of Artificial Sequence: Synthetic oligonucleotide
aggucuacccagaaggacc

SEQ ID NO: 1190 - RNA, 19 nt, Artificial Sequence
  Description of Artificial Sequence: Synthetic oligonucleotide
gguccuucuggguagaccu

SEQ ID NO: 1191 - RNA, 19 nt, Artificial Sequence
  Description of Artificial Sequence: Synthetic oligonucleotide
ggucuacccagaaggaccc

SEQ ID NO: 1192 - RNA, 19 nt, Artificial Sequence
  Description of Artificial Sequence: Synthetic oligonucleotide
ggguccuucuggguagacc

SEQ ID NO: 1193 - RNA, 19 nt, Artificial Sequence
  Description of Artificial Sequence: Synthetic oligonucleotide
acccagaaggacccaguuc

SEQ ID NO: 1194 - RNA, 19 nt, Artificial Sequence
  Description of Artificial Sequence: Synthetic oligonucleotide
gaacuggguccuucugggu

SEQ ID NO: 1195 - RNA, 19 nt, Artificial Sequence
  Description of Artificial Sequence: Synthetic oligonucleotide
cccagaaggacccaguucc

SEQ ID NO: 1196 - RNA, 19 nt, Artificial Sequence
  Description of Artificial Sequence: Synthetic oligonucleotide
ggaacuggguccuucuggg

SEQ ID NO: 1197 - RNA, 19 nt, Artificial Sequence
  Description of Artificial Sequence: Synthetic oligonucleotide
ccagaaggacccaguuccu

SEQ ID NO: 1198 - RNA, 19 nt, Artificial Sequence
  Description of Artificial Sequence: Synthetic oligonucleotide
aggaacuggguccuucugg

SEQ ID NO: 1199 - RNA, 19 nt, Artificial Sequence
  Description of Artificial Sequence: Synthetic oligonucleotide
cagaaggacccaguuccuu

SEQ ID NO: 1200 - RNA, 19 nt, Artificial Sequence
  Description of Artificial Sequence: Synthetic oligonucleotide
aaggaacuggguccuucug

SEQ ID NO: 1201 - RNA, 19 nt, Artificial Sequence
  Description of Artificial Sequence: Synthetic oligonucleotide
agaaggacccaguuccuua

SEQ ID NO: 1202 - RNA, 19 nt, Artificial Sequence
  Description of Artificial Sequence: Synthetic oligonucleotide
uaaggaacuggguccuucu

SEQ ID NO: 1203 - RNA, 19 nt, Artificial Sequence
  Description of Artificial Sequence: Synthetic oligonucleotide
ggacccaguuccuuaccag

SEQ ID NO: 1204 - RNA, 19 nt, Artificial Sequence
  Description of Artificial Sequence: Synthetic oligonucleotide
cugguaaggaacugggucc

SEQ ID NO: 1205 - RNA, 19 nt, Artificial Sequence
  Description of Artificial Sequence: Synthetic oligonucleotide
acccaguuccuuaccagcc

SEQ ID NO: 1206 - RNA, 19 nt, Artificial Sequence
  Description of Artificial Sequence: Synthetic oligonucleotide
ggcugguaaggaacugggu

SEQ ID NO: 1207 - RNA, 19 nt, Artificial Sequence
  Description of Artificial Sequence: Synthetic oligonucleotide
cccaguuccuuaccagccu

SEQ ID NO: 1208 - RNA, 19 nt, Artificial Sequence
  Description of Artificial Sequence: Synthetic oligonucleotide
aggcugguaaggaacuggg

SEQ ID NO: 1209 - RNA, 19 nt, Artificial Sequence
  Description of Artificial Sequence: Synthetic oligonucleotide
ccaguuccuuaccagccuc

SEQ ID NO: 1210 - RNA, 19 nt, Artificial Sequence
  Description of Artificial Sequence: Synthetic oligonucleotide
gaggcugguaaggaacugg

SEQ ID NO: 1211 - RNA, 19 nt, Artificial Sequence
  Description of Artificial Sequence: Synthetic oligonucleotide
caguuccuuaccagccucc

SEQ ID NO: 1212 - RNA, 19 nt, Artificial Sequence
  Description of Artificial Sequence: Synthetic oligonucleotide
ggaggcugguaaggaacug

SEQ ID NO: 1213 - RNA, 19 nt, Artificial Sequence
  Description of Artificial Sequence: Synthetic oligonucleotide
aguuccuuaccagccuccc

SEQ ID NO: 1214 - RNA, 19 nt, Artificial Sequence
  Description of Artificial Sequence: Synthetic oligonucleotide
gggaggcugguaaggaacu

SEQ ID NO: 1215 - RNA, 19 nt, Artificial Sequence
  Description of Artificial Sequence: Synthetic oligonucleotide
cuuaccagccucccuuucu

SEQ ID NO: 1216 - RNA, 19 nt, Artificial Sequence
  Description of Artificial Sequence: Synthetic oligonucleotide
agaaagggaggcugguaag

SEQ ID NO: 1217 - RNA, 19 nt, Artificial Sequence
  Description of Artificial Sequence: Synthetic oligonucleotide
uaccagccucccuuucucu

SEQ ID NO: 1218 - RNA, 19 nt, Artificial Sequence
  Description of Artificial Sequence: Synthetic oligonucleotide
agagaaagggaggcuggua

SEQ ID NO: 1219 - RNA, 19 nt, Artificial Sequence
  Description of Artificial Sequence: Synthetic oligonucleotide
agccucccuuucucuguca

SEQ ID NO: 1220 - RNA, 19 nt, Artificial Sequence
  Description of Artificial Sequence: Synthetic oligonucleotide
ugacagagaaagggaggcu

SEQ ID NO: 1221 - RNA, 19 nt, Artificial Sequence
  Description of Artificial Sequence: Synthetic oligonucleotide
ccuuucucugucagugggg

SEQ ID NO: 1222 - RNA, 19 nt, Artificial Sequence
  Description of Artificial Sequence: Synthetic oligonucleotide
ccccacugacagagaaagg

SEQ ID NO: 1223 - RNA, 19 nt, Artificial Sequence
  Description of Artificial Sequence: Synthetic oligonucleotide
cugucaguggggacgucau

SEQ ID NO: 1224 - RNA, 19 nt, Artificial Sequence
  Description of Artificial Sequence: Synthetic oligonucleotide
augacguccccacugacag

SEQ ID NO: 1225 - RNA, 19 nt, Artificial Sequence
  Description of Artificial Sequence: Synthetic oligonucleotide
ugucaguggggacgucauc

SEQ ID NO: 1226 - RNA, 19 nt, Artificial Sequence
  Description of Artificial Sequence: Synthetic oligonucleotide
gaugacguccccacugaca

SEQ ID NO: 1227 - RNA, 19 nt, Artificial Sequence
  Description of Artificial Sequence: Synthetic oligonucleotide
ucaguggggacgucaucag

SEQ ID NO: 1228 - RNA, 19 nt, Artificial Sequence
  Description of Artificial Sequence: Synthetic oligonucleotide
cugaugacguccccacuga

SEQ ID NO: 1229 - RNA, 19 nt, Artificial Sequence
  Description of Artificial Sequence: Synthetic oligonucleotide
uggggacgucaucagccaa

SEQ ID NO: 1230 - RNA, 19 nt, Artificial Sequence
  Description of Artificial Sequence: Synthetic oligonucleotide
uuggcugaugacgucccca

SEQ ID NO: 1231 - RNA, 19 nt, Artificial Sequence
  Description of Artificial Sequence: Synthetic oligonucleotide
gggacgucaucagccaagc

SEQ ID NO: 1232 - RNA, 19 nt, Artificial Sequence
  Description of Artificial Sequence: Synthetic oligonucleotide
gcuuggcugaugacguccc

SEQ ID NO: 1233 - RNA, 19 nt, Artificial Sequence
  Description of Artificial Sequence: Synthetic oligonucleotide
gacgucaucagccaagcug

SEQ ID NO: 1234 - RNA, 19 nt, Artificial Sequence
  Description of Artificial Sequence: Synthetic oligonucleotide
cagcuuggcugaugacguc

SEQ ID NO: 1235 - RNA, 19 nt, Artificial Sequence
  Description of Artificial Sequence: Synthetic oligonucleotide
acgucaucagccaagcugg

SEQ ID NO: 1236 - RNA, 19 nt, Artificial Sequence
  Description of Artificial Sequence: Synthetic oligonucleotide
ccagcuuggcugaugacgu

SEQ ID NO: 1237 - RNA, 19 nt, Artificial Sequence
  Description of Artificial Sequence: Synthetic oligonucleotide
gucaucagccaagcuggaa

SEQ ID NO: 1238 - RNA, 19 nt, Artificial Sequence
  Description of Artificial Sequence: Synthetic oligonucleotide
uuccagcuuggcugaugac

SEQ ID NO: 1239 - RNA, 19 nt, Artificial Sequence
  Description of Artificial Sequence: Synthetic oligonucleotide
ucagccaagcuggaagcca

SEQ ID NO: 1240 - RNA, 19 nt, Artificial Sequence
  Description of Artificial Sequence: Synthetic oligonucleotide
uggcuuccagcuuggcuga

SEQ ID NO: 1241 - RNA, 19 nt, Artificial Sequence
  Description of Artificial Sequence: Synthetic oligonucleotide
agccaagcuggaagccauu

SEQ ID NO: 1242 - RNA, 19 nt, Artificial Sequence
  Description of Artificial Sequence: Synthetic oligonucleotide
aauggcuuccagcuuggcu

SEQ ID NO: 1243 - RNA, 19 nt, Artificial Sequence
  Description of Artificial Sequence: Synthetic oligonucleotide
gccaagcuggaagccauua

SEQ ID NO: 1244 - RNA, 19 nt, Artificial Sequence
  Description of Artificial Sequence: Synthetic oligonucleotide
uaauggcuuccagcuuggc

SEQ ID NO: 1245 - RNA, 19 nt, Artificial Sequence
  Description of Artificial Sequence: Synthetic oligonucleotide
ccaagcuggaagccauuaa

SEQ ID NO: 1246 - RNA, 19 nt, Artificial Sequence
  Description of Artificial Sequence: Synthetic oligonucleotide
uuaauggcuuccagcuugg

SEQ ID NO: 1247 - RNA, 19 nt, Artificial Sequence
  Description of Artificial Sequence: Synthetic oligonucleotide
caagcuggaagccauuaau

SEQ ID NO: 1248 - RNA, 19 nt, Artificial Sequence
  Description of Artificial Sequence: Synthetic oligonucleotide
auuaauggcuuccagcuug

SEQ ID NO: 1249 - RNA, 19 nt, Artificial Sequence
  Description of Artificial Sequence: Synthetic oligonucleotide
aagcuggaagccauuaaug

SEQ ID NO: 1250 - RNA, 19 nt, Artificial Sequence
  Description of Artificial Sequence: Synthetic oligonucleotide
cauuaauggcuuccagcuu

SEQ ID NO: 1251 - RNA, 19 nt, Artificial Sequence
  Description of Artificial Sequence: Synthetic oligonucleotide
agcuggaagccauuaauga

SEQ ID NO: 1252 - RNA, 19 nt, Artificial Sequence
  Description of Artificial Sequence: Synthetic oligonucleotide
ucauuaauggcuuccagcu

SEQ ID NO: 1253 - RNA, 19 nt, Artificial Sequence
  Description of Artificial Sequence: Synthetic oligonucleotide
cuggaagccauuaaugaac

SEQ ID NO: 1254 - RNA, 19 nt, Artificial Sequence
  Description of Artificial Sequence: Synthetic oligonucleotide
guucauuaauggcuuccag

SEQ ID NO: 1255 - RNA, 19 nt, Artificial Sequence
  Description of Artificial Sequence: Synthetic oligonucleotide
uggaagccauuaaugaacu

SEQ ID NO: 1256 - RNA, 19 nt, Artificial Sequence
  Description of Artificial Sequence: Synthetic oligonucleotide
aguucauuaauggcuucca

SEQ ID NO: 1257 - RNA, 19 nt, Artificial Sequence
  Description of Artificial Sequence: Synthetic oligonucleotide
agccauuaaugaacuaauu

SEQ ID NO: 1258 - RNA, 19 nt, Artificial Sequence
  Description of Artificial Sequence: Synthetic oligonucleotide
aauuaguucauuaauggcu

SEQ ID NO: 1259 - RNA, 19 nt, Artificial Sequence
  Description of Artificial Sequence: Synthetic oligonucleotide
ccauuaaugaacuaauucg

SEQ ID NO: 1260 - RNA, 19 nt, Artificial Sequence
  Description of Artificial Sequence: Synthetic oligonucleotide
cgaauuaguucauuaaugg

SEQ ID NO: 1261 - RNA, 19 nt, Artificial Sequence
  Description of Artificial Sequence: Synthetic oligonucleotide
cguuuugaccacauauaua

SEQ ID NO: 1262 - RNA, 19 nt, Artificial Sequence
  Description of Artificial Sequence: Synthetic oligonucleotide
uauauauguggucaaaacg

SEQ ID NO: 1263 - RNA, 19 nt, Artificial Sequence
  Description of Artificial Sequence: Synthetic oligonucleotide
accacauauauaccaagcc

SEQ ID NO: 1264 - RNA, 19 nt, Artificial Sequence
  Description of Artificial Sequence: Synthetic oligonucleotide
ggcuugguauauauguggu

SEQ ID NO: 1265 - RNA, 19 nt, Artificial Sequence
  Description of Artificial Sequence: Synthetic oligonucleotide
agagauacccucugagaca

SEQ ID NO: 1266 - RNA, 19 nt, Artificial Sequence
  Description of Artificial Sequence: Synthetic oligonucleotide
ugucucagaggguaucucu

SEQ ID NO: 1267 - RNA, 19 nt, Artificial Sequence
  Description of Artificial Sequence: Synthetic oligonucleotide
gagauacccucugagacag

SEQ ID NO: 1268 - RNA, 19 nt, Artificial Sequence
  Description of Artificial Sequence: Synthetic oligonucleotide
cugucucagaggguaucuc

SEQ ID NO: 1269 - RNA, 19 nt, Artificial Sequence
  Description of Artificial Sequence: Synthetic oligonucleotide
agauacccucugagacaga

SEQ ID NO: 1270 - RNA, 19 nt, Artificial Sequence
  Description of Artificial Sequence: Synthetic oligonucleotide
ucugucucagaggguaucu

SEQ ID NO: 1271 - RNA, 19 nt, Artificial Sequence
  Description of Artificial Sequence: Synthetic oligonucleotide
auacccucugagacagaga

SEQ ID NO: 1272 - RNA, 19 nt, Artificial Sequence
  Description of Artificial Sequence: Synthetic oligonucleotide
ucucugucucagaggguau

SEQ ID NO: 1273 - RNA, 19 nt, Artificial Sequence
  Description of Artificial Sequence: Synthetic oligonucleotide
cagagagccaagcuaaugu

SEQ ID NO: 1274 - RNA, 19 nt, Artificial Sequence
  Description of Artificial Sequence: Synthetic oligonucleotide
acauuagcuuggcucucug

SEQ ID NO: 1275 - RNA, 19 nt, Artificial Sequence
  Description of Artificial Sequence: Synthetic oligonucleotide
agagagccaagcuaaugug

SEQ ID NO: 1276 - RNA, 19 nt, Artificial Sequence
  Description of Artificial Sequence: Synthetic oligonucleotide
cacauuagcuuggcucucu

SEQ ID NO: 1277 - RNA, 19 nt, Artificial Sequence
  Description of Artificial Sequence: Synthetic oligonucleotide
caagcuaaugugguaguga

SEQ ID NO: 1278 - RNA, 19 nt, Artificial Sequence
  Description of Artificial Sequence: Synthetic oligonucleotide
ucacuaccacauuagcuug

SEQ ID NO: 1279 - RNA, 19 nt, Artificial Sequence
  Description of Artificial Sequence: Synthetic oligonucleotide
aagcuaaugugguagugaa

SEQ ID NO: 1280 - RNA, 19 nt, Artificial Sequence
  Description of Artificial Sequence: Synthetic oligonucleotide
uucacuaccacauuagcuu

SEQ ID NO: 1281 - RNA, 19 nt, Artificial Sequence
  Description of Artificial Sequence: Synthetic oligonucleotide
cuaaugugguagugaaaau

SEQ ID NO: 1282 - RNA, 19 nt, Artificial Sequence
  Description of Artificial Sequence: Synthetic oligonucleotide
auuuucacuaccacauuag

SEQ ID NO: 1283 - RNA, 19 nt, Artificial Sequence
  Description of Artificial Sequence: Synthetic oligonucleotide
aaugugguagugaaaaucg

SEQ ID NO: 1284 - RNA, 19 nt, Artificial Sequence
  Description of Artificial Sequence: Synthetic oligonucleotide
cgauuuucacuaccacauu

SEQ ID NO: 1285 - RNA, 19 nt, Artificial Sequence
  Description of Artificial Sequence: Synthetic oligonucleotide
augugguagugaaaaucga

SEQ ID NO: 1286 - RNA, 19 nt, Artificial Sequence
  Description of Artificial Sequence: Synthetic oligonucleotide
ucgauuuucacuaccacau

SEQ ID NO: 1287 - RNA, 19 nt, Artificial Sequence
  Description of Artificial Sequence: Synthetic oligonucleotide
gugguagugaaaaucgagg

SEQ ID NO: 1288 - RNA, 19 nt, Artificial Sequence
  Description of Artificial Sequence: Synthetic oligonucleotide
ccucgauuuucacuaccac

SEQ ID NO: 1289 - RNA, 19 nt, Artificial Sequence
  Description of Artificial Sequence: Synthetic oligonucleotide
ugguagugaaaaucgagga

SEQ ID NO: 1290 - RNA, 19 nt, Artificial Sequence
  Description of Artificial Sequence: Synthetic oligonucleotide
uccucgauuuucacuacca

SEQ ID NO: 1291 - RNA, 19 nt, Artificial Sequence
  Description of Artificial Sequence: Synthetic oligonucleotide
uagugaaaaucgaggaagc

SEQ ID NO: 1292 - RNA, 19 nt, Artificial Sequence
  Description of Artificial Sequence: Synthetic oligonucleotide
gcuuccucgauuuucacua

SEQ ID NO: 1293 - RNA, 19 nt, Artificial Sequence
  Description of Artificial Sequence: Synthetic oligonucleotide
ugaaaaucgaggaagcacc

SEQ ID NO: 1294 - RNA, 19 nt, Artificial Sequence
  Description of Artificial Sequence: Synthetic oligonucleotide
ggugcuuccucgauuuuca

SEQ ID NO: 1295 - RNA, 19 nt, Artificial Sequence
  Description of Artificial Sequence: Synthetic oligonucleotide
aaaucgaggaagcaccucu

SEQ ID NO: 1296 - RNA, 19 nt, Artificial Sequence
  Description of Artificial Sequence: Synthetic oligonucleotide
agaggugcuuccucgauuu

SEQ ID NO: 1297 - RNA, 19 nt, Artificial Sequence
  Description of Artificial Sequence: Synthetic oligonucleotide
aucgaggaagcaccucuca

SEQ ID NO: 1298 - RNA, 19 nt, Artificial Sequence
  Description of Artificial Sequence: Synthetic oligonucleotide
ugagaggugcuuccucgau

SEQ ID NO: 1299 - RNA, 19 nt, Artificial Sequence
  Description of Artificial Sequence: Synthetic oligonucleotide
ucgaggaagcaccucucag

SEQ ID NO: 1300 - RNA, 19 nt, Artificial Sequence
  Description of Artificial Sequence: Synthetic oligonucleotide
cugagaggugcuuccucga

SEQ ID NO: 1301 - RNA, 19 nt, Artificial Sequence
  Description of Artificial Sequence: Synthetic oligonucleotide
cgaggaagcaccucucagc

SEQ ID NO: 1302 - RNA, 19 nt, Artificial Sequence
  Description of Artificial Sequence: Synthetic oligonucleotide
gcugagaggugcuuccucg

SEQ ID NO: 1303 - RNA, 19 nt, Artificial Sequence
  Description of Artificial Sequence: Synthetic oligonucleotide
aggaagcaccucucagccc

SEQ ID NO: 1304 - RNA, 19 nt, Artificial Sequence
  Description of Artificial Sequence: Synthetic oligonucleotide
gggcugagaggugcuuccu

SEQ ID NO: 1305 - RNA, 19 nt, Artificial Sequence
  Description of Artificial Sequence: Synthetic oligonucleotide
ggaagcaccucucagcccc

SEQ ID NO: 1306 - RNA, 19 nt, Artificial Sequence
  Description of Artificial Sequence: Synthetic oligonucleotide
ggggcugagaggugcuucc

SEQ ID NO: 1307 - RNA, 19 nt, Artificial Sequence
  Description of Artificial Sequence: Synthetic oligonucleotide
accucucagccccucagag

SEQ ID NO: 1308 - RNA, 19 nt, Artificial Sequence
  Description of Artificial Sequence: Synthetic oligonucleotide
cucugaggggcugagaggu

SEQ ID NO: 1309 - RNA, 19 nt, Artificial Sequence
  Description of Artificial Sequence: Synthetic oligonucleotide
ccucucagccccucagaga

SEQ ID NO: 1310 - RNA, 19 nt, Artificial Sequence
  Description of Artificial Sequence: Synthetic oligonucleotide
ucucugaggggcugagagg

SEQ ID NO: 1311 - RNA, 19 nt, Artificial Sequence
  Description of Artificial Sequence: Synthetic oligonucleotide
cucucagccccucagagaa

SEQ ID NO: 1312 - RNA, 19 nt, Artificial Sequence
  Description of Artificial Sequence: Synthetic oligonucleotide
uucucugaggggcugagag

SEQ ID NO: 1313 - RNA, 19 nt, Artificial Sequence
  Description of Artificial Sequence: Synthetic oligonucleotide
ucucagccccucagagaau

SEQ ID NO: 1314 - RNA, 19 nt, Artificial Sequence
  Description of Artificial Sequence: Synthetic oligonucleotide
auucucugaggggcugaga

SEQ ID NO: 1315 - RNA, 19 nt, Artificial Sequence
  Description of Artificial Sequence: Synthetic oligonucleotide
cucagccccucagagaaug

SEQ ID NO: 1316 - RNA, 19 nt, Artificial Sequence
  Description of Artificial Sequence: Synthetic oligonucleotide
cauucucugaggggcugag

SEQ ID NO: 1317 - RNA, 19 nt, Artificial Sequence
  Description of Artificial Sequence: Synthetic oligonucleotide
ucagccccucagagaauga

SEQ ID NO: 1318 - RNA, 19 nt, Artificial Sequence
  Description of Artificial Sequence: Synthetic oligonucleotide
ucauucucugaggggcuga

SEQ ID NO: 1319 - RNA, 19 nt, Artificial Sequence
  Description of Artificial Sequence: Synthetic oligonucleotide
cagccccucagagaaugau

SEQ ID NO: 1320 - RNA, 19 nt, Artificial Sequence
  Description of Artificial Sequence: Synthetic oligonucleotide
aucauucucugaggggcug

SEQ ID NO: 1321 - RNA, 19 nt, Artificial Sequence
  Description of Artificial Sequence: Synthetic oligonucleotide
agccccucagagaaugauc

SEQ ID NO: 1322 - RNA, 19 nt, Artificial Sequence
  Description of Artificial Sequence: Synthetic oligonucleotide
gaucauucucugaggggcu

SEQ ID NO: 1323 - RNA, 19 nt, Artificial Sequence
  Description of Artificial Sequence: Synthetic oligonucleotide
ccccucagagaaugaucac

SEQ ID NO: 1324 - RNA, 19 nt, Artificial Sequence
  Description of Artificial Sequence: Synthetic oligonucleotide
gugaucauucucugagggg

SEQ ID NO: 1325 - RNA, 19 nt, Artificial Sequence
  Description of Artificial Sequence: Synthetic oligonucleotide
cucagagaaugaucacccu

SEQ ID NO: 1326 - RNA, 19 nt, Artificial Sequence
  Description of Artificial Sequence: Synthetic oligonucleotide
agggugaucauucucugag

SEQ ID NO: 1327 - RNA, 19 nt, Artificial Sequence
  Description of Artificial Sequence: Synthetic oligonucleotide
ucagagaaugaucacccug

SEQ ID NO: 1328 - RNA, 19 nt, Artificial Sequence
  Description of Artificial Sequence: Synthetic oligonucleotide
cagggugaucauucucuga

SEQ ID NO: 1329 - RNA, 19 nt, Artificial Sequence
  Description of Artificial Sequence: Synthetic oligonucleotide
cagagaaugaucacccuga

SEQ ID NO: 1330 - RNA, 19 nt, Artificial Sequence
  Description of Artificial Sequence: Synthetic oligonucleotide
ucagggugaucauucucug

SEQ ID NO: 1331 - RNA, 19 nt, Artificial Sequence
  Description of Artificial Sequence: Synthetic oligonucleotide
agagaaugaucacccugaa

SEQ ID NO: 1332 - RNA, 19 nt, Artificial Sequence
  Description of Artificial Sequence: Synthetic oligonucleotide
uucagggugaucauucucu

SEQ ID NO: 1333 - RNA, 19 nt, Artificial Sequence
  Description of Artificial Sequence: Synthetic oligonucleotide
agaaugaucacccugaauu

SEQ ID NO: 1334 - RNA, 19 nt, Artificial Sequence
  Description of Artificial Sequence: Synthetic oligonucleotide
aauucagggugaucauucu

SEQ ID NO: 1335 - RNA, 19 nt, Artificial Sequence
  Description of Artificial Sequence: Synthetic oligonucleotide
gaaugaucacccugaauuc

SEQ ID NO: 1336 - RNA, 19 nt, Artificial Sequence
  Description of Artificial Sequence: Synthetic oligonucleotide
gaauucagggugaucauuc

SEQ ID NO: 1337 - RNA, 19 nt, Artificial Sequence
  Description of Artificial Sequence: Synthetic oligonucleotide
aaugaucacccugaauuca

SEQ ID NO: 1338 - RNA, 19 nt, Artificial Sequence
  Description of Artificial Sequence: Synthetic oligonucleotide
ugaauucagggugaucauu

SEQ ID NO: 1339 - RNA, 19 nt, Artificial Sequence
  Description of Artificial Sequence: Synthetic oligonucleotide
augaucacccugaauucau

SEQ ID NO: 1340 - RNA, 19 nt, Artificial Sequence
  Description of Artificial Sequence: Synthetic oligonucleotide
augaauucagggugaucau

SEQ ID NO: 1341 - RNA, 19 nt, Artificial Sequence
  Description of Artificial Sequence: Synthetic oligonucleotide
acccugaauucauugucuc

SEQ ID NO: 1342 - RNA, 19 nt, Artificial Sequence
  Description of Artificial Sequence: Synthetic oligonucleotide
gagacaaugaauucagggu

SEQ ID NO: 1343 - RNA, 19 nt, Artificial Sequence
  Description of Artificial Sequence: Synthetic oligonucleotide
cccugaauucauugucuca

SEQ ID NO: 1344 - RNA, 19 nt, Artificial Sequence
  Description of Artificial Sequence: Synthetic oligonucleotide
ugagacaaugaauucaggg

SEQ ID NO: 1345 - RNA, 19 nt, Artificial Sequence
  Description of Artificial Sequence: Synthetic oligonucleotide
ccugaauucauugucucag

SEQ ID NO: 1346 - RNA, 19 nt, Artificial Sequence
  Description of Artificial Sequence: Synthetic oligonucleotide
cugagacaaugaauucagg

SEQ ID NO: 1347 - RNA, 19 nt, Artificial Sequence
  Description of Artificial Sequence: Synthetic oligonucleotide
gaauucauugucucaguga

SEQ ID NO: 1348 - RNA, 19 nt, Artificial Sequence
  Description of Artificial Sequence: Synthetic oligonucleotide
ucacugagacaaugaauuc

SEQ ID NO: 1349 - RNA, 19 nt, Artificial Sequence
  Description of Artificial Sequence: Synthetic oligonucleotide
aauucauugucucagugaa

SEQ ID NO: 1350 - RNA, 19 nt, Artificial Sequence
  Description of Artificial Sequence: Synthetic oligonucleotide
uucacugagacaaugaauu

SEQ ID NO: 1351 - RNA, 19 nt, Artificial Sequence
  Description of Artificial Sequence: Synthetic oligonucleotide
cauugucucagugaaggaa

SEQ ID NO: 1352 - RNA, 19 nt, Artificial Sequence
  Description of Artificial Sequence: Synthetic oligonucleotide
uuccuucacugagacaaug

SEQ ID NO: 1353 - RNA, 19 nt, Artificial Sequence
  Description of Artificial Sequence: Synthetic oligonucleotide
uugucucagugaaggaaga

SEQ ID NO: 1354 - RNA, 19 nt, Artificial Sequence
  Description of Artificial Sequence: Synthetic oligonucleotide
ucuuccuucacugagacaa

SEQ ID NO: 1355 - RNA, 19 nt, Artificial Sequence
  Description of Artificial Sequence: Synthetic oligonucleotide
ugucucagugaaggaagaa

SEQ ID NO: 1356 - RNA, 19 nt, Artificial Sequence
  Description of Artificial Sequence: Synthetic oligonucleotide
uucuuccuucacugagaca

SEQ ID NO: 1357 - RNA, 19 nt, Artificial Sequence
  Description of Artificial Sequence: Synthetic oligonucleotide
cucagugaaggaagaaccu

SEQ ID NO: 1358 - RNA, 19 nt, Artificial Sequence
  Description of Artificial Sequence: Synthetic oligonucleotide
agguucuuccuucacugag

SEQ ID NO: 1359 - RNA, 19 nt, Artificial Sequence
  Description of Artificial Sequence: Synthetic oligonucleotide
ucagugaaggaagaaccug

SEQ ID NO: 1360 - RNA, 19 nt, Artificial Sequence
  Description of Artificial Sequence: Synthetic oligonucleotide
cagguucuuccuucacuga

SEQ ID NO: 1361 - RNA, 19 nt, Artificial Sequence
  Description of Artificial Sequence: Synthetic oligonucleotide
cagugaaggaagaaccugu

SEQ ID NO: 1362 - RNA, 19 nt, Artificial Sequence
  Description of Artificial Sequence: Synthetic oligonucleotide
acagguucuuccuucacug

SEQ ID NO: 1363 - RNA, 19 nt, Artificial Sequence
  Description of Artificial Sequence: Synthetic oligonucleotide
ggaagaaccuguagaagau

SEQ ID NO: 1364 - RNA, 19 nt, Artificial Sequence
  Description of Artificial Sequence: Synthetic oligonucleotide
aucuucuacagguucuucc

SEQ ID NO: 1365 - RNA, 19 nt, Artificial Sequence
  Description of Artificial Sequence: Synthetic oligonucleotide
gaaccuguagaagaugacc

SEQ ID NO: 1366 - RNA, 19 nt, Artificial Sequence
  Description of Artificial Sequence: Synthetic oligonucleotide
ggucaucuucuacagguuc

SEQ ID NO: 1367 - RNA, 19 nt, Artificial Sequence
  Description of Artificial Sequence: Synthetic oligonucleotide
accuguagaagaugaccuc

SEQ ID NO: 1368 - RNA, 19 nt, Artificial Sequence
  Description of Artificial Sequence: Synthetic oligonucleotide
gaggucaucuucuacaggu

SEQ ID NO: 1369 - RNA, 19 nt, Artificial Sequence
  Description of Artificial Sequence: Synthetic oligonucleotide
ucaaaucugcuuucaucca

SEQ ID NO: 1370 - RNA, 19 nt, Artificial Sequence
  Description of Artificial Sequence: Synthetic oligonucleotide
uggaugaaagcagauuuga

SEQ ID NO: 1371 - RNA, 19 nt, Artificial Sequence
  Description of Artificial Sequence: Synthetic oligonucleotide
uucuugggaggacacuuuu

SEQ ID NO: 1372 - RNA, 19 nt, Artificial Sequence
  Description of Artificial Sequence: Synthetic oligonucleotide
aaaaguguccucccaagaa

SEQ ID NO: 1373 - RNA, 19 nt, Artificial Sequence
  Description of Artificial Sequence: Synthetic oligonucleotide
ucuuuugacauccagcagu

SEQ ID NO: 1374 - RNA, 19 nt, Artificial Sequence
  Description of Artificial Sequence: Synthetic oligonucleotide
acugcuggaugucaaaaga

SEQ ID NO: 1375 - RNA, 19 nt, Artificial Sequence
  Description of Artificial Sequence: Synthetic oligonucleotide
uaagaaauauuacuauaau

SEQ ID NO: 1376 - RNA, 19 nt, Artificial Sequence
  Description of Artificial Sequence: Synthetic oligonucleotide
auuauaguaauauuucuua

SEQ ID NO: 1377 - RNA, 19 nt, Artificial Sequence
  Description of Artificial Sequence: Synthetic oligonucleotide
aagaaauauuacuauaauu

SEQ ID NO: 1378 - RNA, 19 nt, Artificial Sequence
  Description of Artificial Sequence: Synthetic oligonucleotide
aauuauaguaauauuucuu

SEQ ID NO: 1379 - RNA, 19 nt, Artificial Sequence
  Description of Artificial Sequence: Synthetic oligonucleotide
acuucaaguaagaucaaga

SEQ ID NO: 1380 - RNA, 19 nt, Artificial Sequence
  Description of Artificial Sequence: Synthetic oligonucleotide
ucuugaucuuacuugaagu

SEQ ID NO: 1381 - RNA, 19 nt, Artificial Sequence
  Description of Artificial Sequence: Synthetic oligonucleotide
cuucaaguaagaucaagaa

SEQ ID NO: 1382 - RNA, 19 nt, Artificial Sequence
  Description of Artificial Sequence: Synthetic oligonucleotide
uucuugaucuuacuugaag

SEQ ID NO: 1383 - RNA, 19 nt, Artificial Sequence
  Description of Artificial Sequence: Synthetic oligonucleotide
aaugagugagcuggaacag

SEQ ID NO: 1384 - RNA, 19 nt, Artificial Sequence
  Description of Artificial Sequence: Synthetic oligonucleotide
cuguuccagcucacucauu

SEQ ID NO: 1385 - RNA, 19 nt, Artificial Sequence
  Description of Artificial Sequence: Synthetic oligonucleotide
gagugagcuggaacagcaa

SEQ ID NO: 1386 - RNA, 19 nt, Artificial Sequence
  Description of Artificial Sequence: Synthetic oligonucleotide
uugcuguuccagcucacuc

SEQ ID NO: 1387 - RNA, 19 nt, Artificial Sequence
  Description of Artificial Sequence: Synthetic oligonucleotide
ccccuccagaacaucuccc

SEQ ID NO: 1388 - RNA, 19 nt, Artificial Sequence
  Description of Artificial Sequence: Synthetic oligonucleotide
gggagauguucuggagggg

SEQ ID NO: 1389 - RNA, 19 nt, Artificial Sequence
  Description of Artificial Sequence: Synthetic oligonucleotide
cauucuggacaacuuggac

SEQ ID NO: 1390 - RNA, 19 nt, Artificial Sequence
  Description of Artificial Sequence: Synthetic oligonucleotide
guccaaguuguccagaaug

SEQ ID NO: 1391 - RNA, 19 nt, Artificial Sequence
  Description of Artificial Sequence: Synthetic oligonucleotide
ggaagccauuaaugaacua

SEQ ID NO: 1392 - RNA, 19 nt, Artificial Sequence
  Description of Artificial Sequence: Synthetic oligonucleotide
uaguucauuaauggcuucc

SEQ ID NO: 1393 - RNA, 19 nt, Artificial Sequence
  Description of Artificial Sequence: Synthetic oligonucleotide
cugcuuucauccagccacu

SEQ ID NO: 1394 - RNA, 19 nt, Artificial Sequence
  Description of Artificial Sequence: Synthetic oligonucleotide
aguggcuggaugaaagcag

SEQ ID NO: 1395 - RNA, 19 nt, Artificial Sequence
  Description of Artificial Sequence: Synthetic oligonucleotide
gcuuacagugacuguggau

SEQ ID NO: 1396 - RNA, 19 nt, Artificial Sequence
  Description of Artificial Sequence: Synthetic oligonucleotide
auccacagucacuguaagc

SEQ ID NO: 1397 - RNA, 19 nt, Artificial Sequence
  Description of Artificial Sequence: Synthetic oligonucleotide
guugcccuuuuccuugacu

SEQ ID NO: 1398 - RNA, 19 nt, Artificial Sequence
  Description of Artificial Sequence: Synthetic oligonucleotide
agucaaggaaaagggcaac

SEQ ID NO: 1399 - RNA, 19 nt, Artificial Sequence
  Description of Artificial Sequence: Synthetic oligonucleotide
uucaaaaagccaaaauaga

SEQ ID NO: 1400 - RNA, 19 nt, Artificial Sequence
  Description of Artificial Sequence: Synthetic oligonucleotide
ucuauuuuggcuuuuugaa

SEQ ID NO: 1401 - RNA, 19 nt, Artificial Sequence
  Description of Artificial Sequence: Synthetic oligonucleotide
uguucagaucucauagaug

SEQ ID NO: 1402 - RNA, 19 nt, Artificial Sequence
  Description of Artificial Sequence: Synthetic oligonucleotide
caucuaugagaucugaaca

SEQ ID NO: 1403 - RNA, 19 nt, Artificial Sequence
  Description of Artificial Sequence: Synthetic oligonucleotide
guucagaucucauagauga

SEQ ID NO: 1404 - RNA, 19 nt, Artificial Sequence
  Description of Artificial Sequence: Synthetic oligonucleotide
ucaucuaugagaucugaac

SEQ ID NO: 1405 - RNA, 19 nt, Artificial Sequence
  Description of Artificial Sequence: Synthetic oligonucleotide
gaacuacagcuuuuaagau

SEQ ID NO: 1406 - RNA, 19 nt, Artificial Sequence
  Description of Artificial Sequence: Synthetic oligonucleotide
aucuuaaaagcuguaguuc

SEQ ID NO: 1407 - RNA, 19 nt, Artificial Sequence
  Description of Artificial Sequence: Synthetic oligonucleotide
uaagauuguacuuuuaucu

SEQ ID NO: 1408 - RNA, 19 nt, Artificial Sequence
  Description of Artificial Sequence: Synthetic oligonucleotide
agauaaaaguacaaucuua

SEQ ID NO: 1409 - RNA, 19 nt, Artificial Sequence
  Description of Artificial Sequence: Synthetic oligonucleotide
aagauuguacuuuuaucuu

SEQ ID NO: 1410 - RNA, 19 nt, Artificial Sequence
  Description of Artificial Sequence: Synthetic oligonucleotide
aagauaaaaguacaaucuu

SEQ ID NO: 1411 - RNA, 19 nt, Artificial Sequence
  Description of Artificial Sequence: Synthetic oligonucleotide
gcagcccgccuccgccgcc

SEQ ID NO: 1412 - RNA, 19 nt, Artificial Sequence
  Description of Artificial Sequence: Synthetic oligonucleotide
ggcggcggaggcgggcugc

SEQ ID NO: 1413 - RNA, 19 nt, Artificial Sequence
  Description of Artificial Sequence: Synthetic oligonucleotide
uucuuuaucauuucucuuc

SEQ ID NO: 1414 - RNA, 19 nt, Artificial Sequence
  Description of Artificial Sequence: Synthetic oligonucleotide
gaagagaaaugauaaagaa

SEQ ID NO: 1415 - RNA, 19 nt, Artificial Sequence
  Description of Artificial Sequence: Synthetic oligonucleotide
ucuuuaucauuucucuucc

SEQ ID NO: 1416 - RNA, 19 nt, Artificial Sequence
  Description of Artificial Sequence: Synthetic oligonucleotide
ggaagagaaaugauaaaga

SEQ ID NO: 1417 - RNA, 19 nt, Artificial Sequence
  Description of Artificial Sequence: Synthetic oligonucleotide
aucauuucucuucccccuu

SEQ ID NO: 1418 - RNA, 19 nt, Artificial Sequence
  Description of Artificial Sequence: Synthetic oligonucleotide
aagggggaagagaaaugau

SEQ ID NO: 1419 - RNA, 19 nt, Artificial Sequence
  Description of Artificial Sequence: Synthetic oligonucleotide
ucauuucucuucccccuuu

SEQ ID NO: 1420 - RNA, 19 nt, Artificial Sequence
  Description of Artificial Sequence: Synthetic oligonucleotide
aaagggggaagagaaauga

SEQ ID NO: 1421 - RNA, 19 nt, Artificial Sequence
  Description of Artificial Sequence: Synthetic oligonucleotide
ucuucccccuuuuuggcau

SEQ ID NO: 1422 - RNA, 19 nt, Artificial Sequence
  Description of Artificial Sequence: Synthetic oligonucleotide
augccaaaaagggggaaga

SEQ ID NO: 1423 - RNA, 19 nt, Artificial Sequence
  Description of Artificial Sequence: Synthetic oligonucleotide
ccuggcuugccuccaguuu

SEQ ID NO: 1424 - RNA, 19 nt, Artificial Sequence
  Description of Artificial Sequence: Synthetic oligonucleotide
aaacuggaggcaagccagg

SEQ ID NO: 1425 - RNA, 19 nt, Artificial Sequence
  Description of Artificial Sequence: Synthetic oligonucleotide
aacaccugcugagggggcu

SEQ ID NO: 1426 - RNA, 19 nt, Artificial Sequence
  Description of Artificial Sequence: Synthetic oligonucleotide
agcccccucagcagguguu

SEQ ID NO: 1427 - RNA, 19 nt, Artificial Sequence
  Description of Artificial Sequence: Synthetic oligonucleotide
acaccugcugagggggcuc

SEQ ID NO: 1428 - RNA, 19 nt, Artificial Sequence
  Description of Artificial Sequence: Synthetic oligonucleotide
gagcccccucagcaggugu

SEQ ID NO: 1429 - RNA, 19 nt, Artificial Sequence
  Description of Artificial Sequence: Synthetic oligonucleotide
caccugcugagggggcucu

SEQ ID NO: 1430 - RNA, 19 nt, Artificial Sequence
  Description of Artificial Sequence: Synthetic oligonucleotide
agagcccccucagcaggug

SEQ ID NO: 1431 - RNA, 19 nt, Artificial Sequence
  Description of Artificial Sequence: Synthetic oligonucleotide
gagggggcucuuucccuca

SEQ ID NO: 1432 - RNA, 19 nt, Artificial Sequence
  Description of Artificial Sequence: Synthetic oligonucleotide
ugagggaaagagcccccuc

SEQ ID NO: 1433 - RNA, 19 nt, Artificial Sequence
  Description of Artificial Sequence: Synthetic oligonucleotide
aucaagaaucuuuugugaa

SEQ ID NO: 1434 - RNA, 19 nt, Artificial Sequence
  Description of Artificial Sequence: Synthetic oligonucleotide
uucacaaaagauucuugau

SEQ ID NO: 1435 - RNA, 19 nt, Artificial Sequence
  Description of Artificial Sequence: Synthetic oligonucleotide
uccugcuaguguagcuucu

SEQ ID NO: 1436 - RNA, 19 nt, Artificial Sequence
  Description of Artificial Sequence: Synthetic oligonucleotide
agaagcuacacuagcagga

SEQ ID NO: 1437 - RNA, 19 nt, Artificial Sequence
  Description of Artificial Sequence: Synthetic oligonucleotide
cccggccggccaggcccug

SEQ ID NO: 1438 - RNA, 19 nt, Artificial Sequence
  Description of Artificial Sequence: Synthetic oligonucleotide
cagggccuggccggccggg

SEQ ID NO: 1439 - RNA, 19 nt, Artificial Sequence
  Description of Artificial Sequence: Synthetic oligonucleotide
ggccaggcccugccgcuca

SEQ ID NO: 1440 - RNA, 19 nt, Artificial Sequence
  Description of Artificial Sequence: Synthetic oligonucleotide
ugagcggcagggccuggcc

SEQ ID NO: 1441 - RNA, 19 nt, Artificial Sequence
  Description of Artificial Sequence: Synthetic oligonucleotide
ccggaggcagcgagcgggg

SEQ ID NO: 1442 - DNA, 19 bp, Artificial Sequence
  Description of Combined DNA/RNA Molecule: Synthetic oligonucleotide
  Description of Artificial Sequence: Synthetic oligonucleotide
ccccgctcgctgcctccgg

SEQ ID NO: 1443 - RNA, 19 nt, Artificial Sequence
  Description of Artificial Sequence: Synthetic oligonucleotide
cggaggcagcgagcggggg

SEQ ID NO: 1444 - DNA, 19 bp, Artificial Sequence
  Description of Combined DNA/RNA Molecule: Synthetic oligonucleotide
  Description of Artificial Sequence: Synthetic oligonucleotide
cccccgctcgctgcctccg

SEQ ID NO: 1445 - RNA, 19 nt, Artificial Sequence
  Description of Artificial Sequence: Synthetic oligonucleotide
ggaggcagcgagcgggggg

SEQ ID NO: 1446 - DNA, 19 bp, Artificial Sequence
  Description of Combined DNA/RNA Molecule: Synthetic oligonucleotide
  Description of Artificial Sequence: Synthetic oligonucleotide
ccccccgctcgctgcctcc

SEQ ID NO: 1447 - RNA, 19 nt, Artificial Sequence
  Description of Artificial Sequence: Synthetic oligonucleotide
gagaaggcgcugaggagga

SEQ ID NO: 1448 - RNA, 19 nt, Artificial Sequence
  Description of Artificial Sequence: Synthetic oligonucleotide
uccuccucagcgccuucuc

SEQ ID NO: 1449 - RNA, 19 nt, Artificial Sequence
  Description of Artificial Sequence: Synthetic oligonucleotide
gaaggcgcugaggaggaaa

SEQ ID NO: 1450 - RNA, 19 nt, Artificial Sequence
  Description of Artificial Sequence: Synthetic oligonucleotide
uuuccuccucagcgccuuc

SEQ ID NO: 1451 - RNA, 19 nt, Artificial Sequence
  Description of Artificial Sequence: Synthetic oligonucleotide
agaguagcagcucagacug

SEQ ID NO: 1452 - RNA, 19 nt, Artificial Sequence
  Description of Artificial Sequence: Synthetic oligonucleotide
cagucugagcugcuacucu

SEQ ID NO: 1453 - RNA, 19 nt, Artificial Sequence
  Description of Artificial Sequence: Synthetic oligonucleotide
agaagaagagaaccaaaaa

SEQ ID NO: 1454 - DNA, 19 bp, Artificial Sequence
  Description of Combined DNA/RNA Molecule: Synthetic oligonucleotide
  Description of Artificial Sequence: Synthetic oligonucleotide
tttttggttctcttcttct

SEQ ID NO: 1455 - RNA, 19 nt, Artificial Sequence
  Description of Artificial Sequence: Synthetic oligonucleotide
aagaagagaaccaaaaacu

SEQ ID NO: 1456 - RNA, 19 nt, Artificial Sequence
  Description of Artificial Sequence: Synthetic oligonucleotide
aguuuuugguucucuucuu

SEQ ID NO: 1457 - RNA, 19 nt, Artificial Sequence
  Description of Artificial Sequence: Synthetic oligonucleotide
uugcuagaaaaucagcuuu

SEQ ID NO: 1458 - RNA, 19 nt, Artificial Sequence
  Description of Artificial Sequence: Synthetic oligonucleotide
aaagcugauuuucuagcaa

SEQ ID NO: 1459 - RNA, 19 nt, Artificial Sequence
  Description of Artificial Sequence: Synthetic oligonucleotide
ggauggaugcccugguugc

SEQ ID NO: 1460 - RNA, 19 nt, Artificial Sequence
  Description of Artificial Sequence: Synthetic oligonucleotide
gcaaccagggcauccaucc

SEQ ID NO: 1461 - RNA, 19 nt, Artificial Sequence
  Description of Artificial Sequence: Synthetic oligonucleotide
gcggaagccaaggggaaug

SEQ ID NO: 1462 - RNA, 19 nt, Artificial Sequence
  Description of Artificial Sequence: Synthetic oligonucleotide
cauuccccuuggcuuccgc

SEQ ID NO: 1463 - RNA, 19 nt, Artificial Sequence
  Description of Artificial Sequence: Synthetic oligonucleotide
caguggccgggucugcuga

SEQ ID NO: 1464 - RNA, 19 nt, Artificial Sequence
  Description of Artificial Sequence: Synthetic oligonucleotide
ucagcagacccggccacug

SEQ ID NO: 1465 - RNA, 19 nt, Artificial Sequence
  Description of Artificial Sequence: Synthetic oligonucleotide
acaacuuggacccagucau

SEQ ID NO: 1466 - RNA, 19 nt, Artificial Sequence
  Description of Artificial Sequence: Synthetic oligonucleotide
augacuggguccaaguugu

SEQ ID NO: 1467 - RNA, 19 nt, Artificial Sequence
  Description of Artificial Sequence: Synthetic oligonucleotide
cagucauguucuucaaaug

SEQ ID NO: 1468 - RNA, 19 nt, Artificial Sequence
  Description of Artificial Sequence: Synthetic oligonucleotide
cauuugaagaacaugacug

SEQ ID NO: 1469 - RNA, 19 nt, Artificial Sequence
  Description of Artificial Sequence: Synthetic oligonucleotide
aggagcucccagaggucua

SEQ ID NO: 1470 - RNA, 19 nt, Artificial Sequence
  Description of Artificial Sequence: Synthetic oligonucleotide
uagaccucugggagcuccu

SEQ ID NO: 1471 - RNA, 19 nt, Artificial Sequence
  Description of Artificial Sequence: Synthetic oligonucleotide
cagccucccuuucucuguc

SEQ ID NO: 1472 - RNA, 19 nt, Artificial Sequence
  Description of Artificial Sequence: Synthetic oligonucleotide
gacagagaaagggaggcug

SEQ ID NO: 1473 - RNA, 19 nt, Artificial Sequence
  Description of Artificial Sequence: Synthetic oligonucleotide
ucaucagccaagcuggaag

SEQ ID NO: 1474 - RNA, 19 nt, Artificial Sequence
  Description of Artificial Sequence: Synthetic oligonucleotide
cuuccagcuuggcugauga

SEQ ID NO: 1475 - RNA, 19 nt, Artificial Sequence
  Description of Artificial Sequence: Synthetic oligonucleotide
aagccauuaaugaacuaau

SEQ ID NO: 1476 - RNA, 19 nt, Artificial Sequence
  Description of Artificial Sequence: Synthetic oligonucleotide
auuaguucauuaauggcuu

SEQ ID NO: 1477 - RNA, 19 nt, Artificial Sequence
  Description of Artificial Sequence: Synthetic oligonucleotide
gacagagagccaagcuaau

SEQ ID NO: 1478 - RNA, 19 nt, Artificial Sequence
  Description of Artificial Sequence: Synthetic oligonucleotide
auuagcuuggcucucuguc

SEQ ID NO: 1479 - RNA, 19 nt, Artificial Sequence
  Description of Artificial Sequence: Synthetic oligonucleotide
gaagcaccucucagccccu

SEQ ID NO: 1480 - RNA, 19 nt, Artificial Sequence
  Description of Artificial Sequence: Synthetic oligonucleotide
aggggcugagaggugcuuc

SEQ ID NO: 1481 - RNA, 19 nt, Artificial Sequence
  Description of Artificial Sequence: Synthetic oligonucleotide
gcaccucucagccccucag

SEQ ID NO: 1482 - RNA, 19 nt, Artificial Sequence
  Description of Artificial Sequence: Synthetic oligonucleotide
cugaggggcugagaggugc

SEQ ID NO: 1483 - RNA, 19 nt, Artificial Sequence
  Description of Artificial Sequence: Synthetic oligonucleotide
caccucucagccccucaga

SEQ ID NO: 1484 - RNA, 19 nt, Artificial Sequence
  Description of Artificial Sequence: Synthetic oligonucleotide
ucugaggggcugagaggug

SEQ ID NO: 1485 - RNA, 19 nt, Artificial Sequence
  Description of Artificial Sequence: Synthetic oligonucleotide
agugaaggaagaaccugua

SEQ ID NO: 1486 - RNA, 19 nt, Artificial Sequence
  Description of Artificial Sequence: Synthetic oligonucleotide
uacagguucuuccuucacu

SEQ ID NO: 1487 - RNA, 19 nt, Artificial Sequence
  Description of Artificial Sequence: Synthetic oligonucleotide
aaccuguagaagaugaccu

SEQ ID NO: 1488 - RNA, 19 nt, Artificial Sequence
  Description of Artificial Sequence: Synthetic oligonucleotide
aggucaucuucuacagguu

SEQ ID NO: 1489 - RNA, 19 nt, Artificial Sequence
  Description of Artificial Sequence: Synthetic oligonucleotide
agcccggaggcagcgagcg

SEQ ID NO: 1490 - DNA, 19 bp, Artificial Sequence
  Description of Combined DNA/RNA Molecule: Synthetic oligonucleotide
  Description of Artificial Sequence: Synthetic oligonucleotide
cgctcgctgcctccgggct

SEQ ID NO: 1491 - RNA, 19 nt, Artificial Sequence
  Description of Artificial Sequence: Synthetic oligonucleotide
gacaacuuggacccaguca

SEQ ID NO: 1492 - RNA, 19 nt, Artificial Sequence
  Description of Artificial Sequence: Synthetic oligonucleotide
ugacuggguccaaguuguc

SEQ ID NO: 1493 - RNA, 19 nt, Artificial Sequence
  Description of Artificial Sequence: Synthetic oligonucleotide
ccagccucccuuucucugu

SEQ ID NO: 1494 - RNA, 19 nt, Artificial Sequence
  Description of Artificial Sequence: Synthetic oligonucleotide
acagagaaagggaggcugg

SEQ ID NO: 1495 - RNA, 19 nt, Artificial Sequence
  Description of Artificial Sequence: Synthetic oligonucleotide
uuuuuuccugcuaguguag

SEQ ID NO: 1496 - RNA, 19 nt, Artificial Sequence
  Description of Artificial Sequence: Synthetic oligonucleotide
cuacacuagcaggaaaaaa

SEQ ID NO: 1497 - RNA, 19 nt, Artificial Sequence
  Description of Artificial Sequence: Synthetic oligonucleotide
uuuuuccugcuaguguagc

SEQ ID NO: 1498 - RNA, 19 nt, Artificial Sequence
  Description of Artificial Sequence: Synthetic oligonucleotide
gcuacacuagcaggaaaaa

SEQ ID NO: 1499 - RNA, 19 nt, Artificial Sequence
  Description of Artificial Sequence: Synthetic oligonucleotide
gggcauucuggacaacuug

SEQ ID NO: 1500 - RNA, 19 nt, Artificial Sequence
  Description of Artificial Sequence: Synthetic oligonucleotide
caaguuguccagaaugccc

SEQ ID NO: 1501 - RNA, 19 nt, Artificial Sequence
  Description of Artificial Sequence: Synthetic oligonucleotide
acuggaugcuuacagugac

SEQ ID NO: 1502 - RNA, 19 nt, Artificial Sequence
  Description of Artificial Sequence: Synthetic oligonucleotide
gucacuguaagcauccagu

SEQ ID NO: 1503 - RNA, 19 nt, Artificial Sequence
  Description of Artificial Sequence: Synthetic oligonucleotide
acucuucagauucagaguc

SEQ ID NO: 1504 - RNA, 19 nt, Artificial Sequence
  Description of Artificial Sequence: Synthetic oligonucleotide
gacucugaaucugaagagu

SEQ ID NO: 1505 - RNA, 19 nt, Artificial Sequence
  Description of Artificial Sequence: Synthetic oligonucleotide
gucugauauccuguugggc

SEQ ID NO: 1506 - RNA, 19 nt, Artificial Sequence
  Description of Artificial Sequence: Synthetic oligonucleotide
gcccaacaggauaucagac

SEQ ID NO: 1507 - RNA, 19 nt, Artificial Sequence
  Description of Artificial Sequence: Synthetic oligonucleotide
aguggggacgucaucagcc

SEQ ID NO: 1508 - RNA, 19 nt, Artificial Sequence
  Description of Artificial Sequence: Synthetic oligonucleotide
ggcugaugacguccccacu

SEQ ID NO: 1509 - RNA, 19 nt, Artificial Sequence
  Description of Artificial Sequence: Synthetic oligonucleotide
gaagaaccuguagaagaug

SEQ ID NO: 1510 - RNA, 19 nt, Artificial Sequence
  Description of Artificial Sequence: Synthetic oligonucleotide
caucuucuacagguucuuc

SEQ ID NO: 1511 - RNA, 19 nt, Artificial Sequence
  Description of Artificial Sequence: Synthetic oligonucleotide
cuacuggaugcuuacagug

SEQ ID NO: 1512 - RNA, 19 nt, Artificial Sequence
  Description of Artificial Sequence: Synthetic oligonucleotide
cacuguaagcauccaguag

SEQ ID NO: 1513 - RNA, 19 nt, Artificial Sequence
  Description of Artificial Sequence: Synthetic oligonucleotide
guauugagacauauuacug

SEQ ID NO: 1514 - RNA, 19 nt, Artificial Sequence
  Description of Artificial Sequence: Synthetic oligonucleotide
caguaauaugucucaauac

SEQ ID NO: 1515 - RNA, 19 nt, Artificial Sequence
  Description of Artificial Sequence: Synthetic oligonucleotide
cuauaauugagaacuacag

SEQ ID NO: 1516 - RNA, 19 nt, Artificial Sequence
  Description of Artificial Sequence: Synthetic oligonucleotide
cuguaguucucaauuauag

SEQ ID NO: 1517 - RNA, 19 nt, Artificial Sequence
  Description of Artificial Sequence: Synthetic oligonucleotide
cuucugucggggcagcccg

SEQ ID NO: 1518 - RNA, 19 nt, Artificial Sequence
  Description of Artificial Sequence: Synthetic oligonucleotide
cgggcugccccgacagaag

SEQ ID NO: 1519 - RNA, 19 nt, Artificial Sequence
  Description of Artificial Sequence: Synthetic oligonucleotide
uacuuuuaucuuaaaaggg

SEQ ID NO: 1520 - RNA, 19 nt, Artificial Sequence
  Description of Artificial Sequence: Synthetic oligonucleotide
cccuuuuaagauaaaagua

SEQ ID NO: 1521 - RNA, 19 nt, Artificial Sequence
  Description of Artificial Sequence: Synthetic oligonucleotide
cucuucccccuuuuuggca

SEQ ID NO: 1522 - RNA, 19 nt, Artificial Sequence
  Description of Artificial Sequence: Synthetic oligonucleotide
ugccaaaaagggggaagag

SEQ ID NO: 1523 - RNA, 19 nt, Artificial Sequence
  Description of Artificial Sequence: Synthetic oligonucleotide
ccccuuuuuggcauccugg

SEQ ID NO: 1524 - RNA, 19 nt, Artificial Sequence
  Description of Artificial Sequence: Synthetic oligonucleotide
ccaggaugccaaaaagggg

SEQ ID NO: 1525 - RNA, 19 nt, Artificial Sequence
  Description of Artificial Sequence: Synthetic oligonucleotide
cuuuuuggcauccuggcuu

SEQ ID NO: 1526 - RNA, 19 nt, Artificial Sequence
  Description of Artificial Sequence: Synthetic oligonucleotide
aagccaggaugccaaaaag

SEQ ID NO: 1527 - RNA, 19 nt, Artificial Sequence
  Description of Artificial Sequence: Synthetic oligonucleotide
cuugauggaauuuuuuccu

SEQ ID NO: 1528 - RNA, 19 nt, Artificial Sequence
  Description of Artificial Sequence: Synthetic oligonucleotide
aggaaaaaauuccaucaag

SEQ ID NO: 1529 - RNA, 19 nt, Artificial Sequence
  Description of Artificial Sequence: Synthetic oligonucleotide
uugauggaauuuuuuccug

SEQ ID NO: 1530 - RNA, 19 nt, Artificial Sequence
  Description of Artificial Sequence: Synthetic oligonucleotide
caggaaaaaauuccaucaa

SEQ ID NO: 1531 - RNA, 19 nt, Artificial Sequence
  Description of Artificial Sequence: Synthetic oligonucleotide
ugauggaauuuuuuccugc

SEQ ID NO: 1532 - RNA, 19 nt, Artificial Sequence
  Description of Artificial Sequence: Synthetic oligonucleotide
gcaggaaaaaauuccauca

SEQ ID NO: 1533 - RNA, 19 nt, Artificial Sequence
  Description of Artificial Sequence: Synthetic oligonucleotide
uagcagcucagacugccag

SEQ ID NO: 1534 - RNA, 19 nt, Artificial Sequence
  Description of Artificial Sequence: Synthetic oligonucleotide
cuggcagucugagcugcua

SEQ ID NO: 1535 - RNA, 19 nt, Artificial Sequence
  Description of Artificial Sequence: Synthetic oligonucleotide
aagugguagauuuagaaga

SEQ ID NO: 1536 - RNA, 19 nt, Artificial Sequence
  Description of Artificial Sequence: Synthetic oligonucleotide
ucuucuaaaucuaccacuu

SEQ ID NO: 1537 - RNA, 19 nt, Artificial Sequence
  Description of Artificial Sequence: Synthetic oligonucleotide
agugguagauuuagaagaa

SEQ ID NO: 1538 - RNA, 19 nt, Artificial Sequence
  Description of Artificial Sequence: Synthetic oligonucleotide
uucuucuaaaucuaccacu

SEQ ID NO: 1539 - RNA, 19 nt, Artificial Sequence
  Description of Artificial Sequence: Synthetic oligonucleotide
gacucuucagauucagagu

SEQ ID NO: 1540 - RNA, 19 nt, Artificial Sequence
  Description of Artificial Sequence: Synthetic oligonucleotide
acucugaaucugaagaguc

SEQ ID NO: 1541 - RNA, 19 nt, Artificial Sequence
  Description of Artificial Sequence: Synthetic oligonucleotide
cuguugggcauucuggaca

SEQ ID NO: 1542 - RNA, 19 nt, Artificial Sequence
  Description of Artificial Sequence: Synthetic oligonucleotide
uguccagaaugcccaacag

SEQ ID NO: 1543 - RNA, 19 nt, Artificial Sequence
  Description of Artificial Sequence: Synthetic oligonucleotide
uggacaacuuggacccagu

SEQ ID NO: 1544 - RNA, 19 nt, Artificial Sequence
  Description of Artificial Sequence: Synthetic oligonucleotide
acuggguccaaguugucca

SEQ ID NO: 1545 - RNA, 19 nt, Artificial Sequence
  Description of Artificial Sequence: Synthetic oligonucleotide
guucuucaaaugcccuucc

SEQ ID NO: 1546 - RNA, 19 nt, Artificial Sequence
  Description of Artificial Sequence: Synthetic oligonucleotide
ggaagggcauuugaagaac

SEQ ID NO: 1547 - RNA, 19 nt, Artificial Sequence
  Description of Artificial Sequence: Synthetic oligonucleotide
cccuuucucugucaguggg

SEQ ID NO: 1548 - RNA, 19 nt, Artificial Sequence
  Description of Artificial Sequence: Synthetic oligonucleotide
cccacugacagagaaaggg

SEQ ID NO: 1549 - RNA, 19 nt, Artificial Sequence
  Description of Artificial Sequence: Synthetic oligonucleotide
caguggggacgucaucagc

SEQ ID NO: 1550 - RNA, 19 nt, Artificial Sequence
  Description of Artificial Sequence: Synthetic oligonucleotide
gcugaugacguccccacug

SEQ ID NO: 1551 - RNA, 19 nt, Artificial Sequence
  Description of Artificial Sequence: Synthetic oligonucleotide
ucucagugaaggaagaacc

SEQ ID NO: 1552 - RNA, 19 nt, Artificial Sequence
  Description of Artificial Sequence: Synthetic oligonucleotide
gguucuuccuucacugaga

SEQ ID NO: 1553 - RNA, 19 nt, Artificial Sequence
  Description of Artificial Sequence: Synthetic oligonucleotide
acacuuuugccaaugaacu

SEQ ID NO: 1554 - RNA, 19 nt, Artificial Sequence
  Description of Artificial Sequence: Synthetic oligonucleotide
aguucauuggcaaaagugu

SEQ ID NO: 1555 - RNA, 19 nt, Artificial Sequence
  Description of Artificial Sequence: Synthetic oligonucleotide
cuuuugacauccagcaguc

SEQ ID NO: 1556 - RNA, 19 nt, Artificial Sequence
  Description of Artificial Sequence: Synthetic oligonucleotide
gacugcuggaugucaaaag

SEQ ID NO: 1557 - RNA, 19 nt, Artificial Sequence
  Description of Artificial Sequence: Synthetic oligonucleotide
uagacaaaugucuugaagu

SEQ ID NO: 1558 - RNA, 19 nt, Artificial Sequence
  Description of Artificial Sequence: Synthetic oligonucleotide
acuucaagacauuugucua

SEQ ID NO: 1559 - RNA, 19 nt, Artificial Sequence
  Description of Artificial Sequence: Synthetic oligonucleotide
gaauuuaugaaugguucuu

SEQ ID NO: 1560 - RNA, 19 nt, Artificial Sequence
  Description of Artificial Sequence: Synthetic oligonucleotide
aagaaccauucauaaauuc

SEQ ID NO: 1561 - RNA, 19 nt, Artificial Sequence
  Description of Artificial Sequence: Synthetic oligonucleotide
aauuuaugaaugguucuuu

SEQ ID NO: 1562 - RNA, 19 nt, Artificial Sequence
  Description of Artificial Sequence: Synthetic oligonucleotide
aaagaaccauucauaaauu

SEQ ID NO: 1563 - RNA, 19 nt, Artificial Sequence
  Description of Artificial Sequence: Synthetic oligonucleotide
uucccccuuuuuggcaucc

SEQ ID NO: 1564 - RNA, 19 nt, Artificial Sequence
  Description of Artificial Sequence: Synthetic oligonucleotide
ggaugccaaaaagggggaa

SEQ ID NO: 1565 - RNA, 19 nt, Artificial Sequence
  Description of Artificial Sequence: Synthetic oligonucleotide
gcccugccgcucauggugc

SEQ ID NO: 1566 - RNA, 19 nt, Artificial Sequence
  Description of Artificial Sequence: Synthetic oligonucleotide
gcaccaugagcggcagggc

SEQ ID NO: 1567 - RNA, 19 nt, Artificial Sequence
  Description of Artificial Sequence: Synthetic oligonucleotide
cucauggugccagcccaga

SEQ ID NO: 1568 - RNA, 19 nt, Artificial Sequence
  Description of Artificial Sequence: Synthetic oligonucleotide
ucugggcuggcaccaugag

SEQ ID NO: 1569 - RNA, 19 nt, Artificial Sequence
  Description of Artificial Sequence: Synthetic oligonucleotide
cucgaaugagugagcugga

SEQ ID NO: 1570 - RNA, 19 nt, Artificial Sequence
  Description of Artificial Sequence: Synthetic oligonucleotide
uccagcucacucauucgag

SEQ ID NO: 1571 - RNA, 19 nt, Artificial Sequence
  Description of Artificial Sequence: Synthetic oligonucleotide
ucgaaugagugagcuggaa

SEQ ID NO: 1572 - RNA, 19 nt, Artificial Sequence
  Description of Artificial Sequence: Synthetic oligonucleotide
uuccagcucacucauucga

SEQ ID NO: 1573 - RNA, 19 nt, Artificial Sequence
  Description of Artificial Sequence: Synthetic oligonucleotide
augagugagcuggaacagc

SEQ ID NO: 1574 - RNA, 19 nt, Artificial Sequence
  Description of Artificial Sequence: Synthetic oligonucleotide
gcuguuccagcucacucau

SEQ ID NO: 1575 - RNA, 19 nt, Artificial Sequence
  Description of Artificial Sequence: Synthetic oligonucleotide
cuuguaguugagaaccagg

SEQ ID NO: 1576 - RNA, 19 nt, Artificial Sequence
  Description of Artificial Sequence: Synthetic oligonucleotide
ccugguucucaacuacaag

SEQ ID NO: 1577 - RNA, 19 nt, Artificial Sequence
  Description of Artificial Sequence: Synthetic oligonucleotide
agaggaggcggaagccaag

SEQ ID NO: 1578 - DNA, 19 bp, Artificial Sequence
  Description of Combined DNA/RNA Molecule: Synthetic oligonucleotide
  Description of Artificial Sequence: Synthetic oligonucleotide
cttggcttccgcctcctct

SEQ ID NO: 1579 - RNA, 19 nt, Artificial Sequence
  Description of Artificial Sequence: Synthetic oligonucleotide
ggcccaguugucaccccuc

SEQ ID NO: 1580 - RNA, 19 nt, Artificial Sequence
  Description of Artificial Sequence: Synthetic oligonucleotide
gaggggugacaacugggcc

SEQ ID NO: 1581 - RNA, 19 nt, Artificial Sequence
  Description of Artificial Sequence: Synthetic oligonucleotide
ucuacccagaaggacccag

SEQ ID NO: 1582 - RNA, 19 nt, Artificial Sequence
  Description of Artificial Sequence: Synthetic oligonucleotide
cuggguccuucuggguaga

SEQ ID NO: 1583 - RNA, 19 nt, Artificial Sequence
  Description of Artificial Sequence: Synthetic oligonucleotide
cuacccagaaggacccagu

SEQ ID NO: 1584 - RNA, 19 nt, Artificial Sequence
  Description of Artificial Sequence: Synthetic oligonucleotide
acuggguccuucuggguag

SEQ ID NO: 1585 - RNA, 19 nt, Artificial Sequence
  Description of Artificial Sequence: Synthetic oligonucleotide
gcuggaagccauuaaugaa

SEQ ID NO: 1586 - RNA, 19 nt, Artificial Sequence
  Description of Artificial Sequence: Synthetic oligonucleotide
uucauuaauggcuuccagc

SEQ ID NO: 1587 - RNA, 19 nt, Artificial Sequence
  Description of Artificial Sequence: Synthetic oligonucleotide
uagagauacccucugagac

SEQ ID NO: 1588 - RNA, 19 nt, Artificial Sequence
  Description of Artificial Sequence: Synthetic oligonucleotide
gucucagaggguaucucua

SEQ ID NO: 1589 - RNA, 19 nt, Artificial Sequence
  Description of Artificial Sequence: Synthetic oligonucleotide
agagccaagcuaauguggu

SEQ ID NO: 1590 - RNA, 19 nt, Artificial Sequence
  Description of Artificial Sequence: Synthetic oligonucleotide
accacauuagcuuggcucu

SEQ ID NO: 1591 - RNA, 19 nt, Artificial Sequence
  Description of Artificial Sequence: Synthetic oligonucleotide
aaggaagaaccuguagaag

SEQ ID NO: 1592 - RNA, 19 nt, Artificial Sequence
  Description of Artificial Sequence: Synthetic oligonucleotide
cuucuacagguucuuccuu

SEQ ID NO: 1593 - RNA, 19 nt, Artificial Sequence
  Description of Artificial Sequence: Synthetic oligonucleotide
aagaaccuguagaagauga

SEQ ID NO: 1594 - RNA, 19 nt, Artificial Sequence
  Description of Artificial Sequence: Synthetic oligonucleotide
ucaucuucuacagguucuu

SEQ ID NO: 1595 - RNA, 19 nt, Artificial Sequence
  Description of Artificial Sequence: Synthetic oligonucleotide
aggagaaggcgcugaggag

SEQ ID NO: 1596 - RNA, 19 nt, Artificial Sequence
  Description of Artificial Sequence: Synthetic oligonucleotide
cuccucagcgccuucuccu

SEQ ID NO: 1597 - RNA, 19 nt, Artificial Sequence
  Description of Artificial Sequence: Synthetic oligonucleotide
gaagaagagaaccaaaaac

SEQ ID NO: 1598 - DNA, 19 bp, Artificial Sequence
  Description of Combined DNA/RNA Molecule: Synthetic oligonucleotide
  Description of Artificial Sequence: Synthetic oligonucleotide
gtttttggttctcttcttc

SEQ ID NO: 1599 - RNA, 19 nt, Artificial Sequence
  Description of Artificial Sequence: Synthetic oligonucleotide
gaagccauuaaugaacuaa

SEQ ID NO: 1600 - RNA, 19 nt, Artificial Sequence
  Description of Artificial Sequence: Synthetic oligonucleotide
uuaguucauuaauggcuuc

SEQ ID NO: 1601 - RNA, 19 nt, Artificial Sequence
  Description of Artificial Sequence: Synthetic oligonucleotide
ugagacagagagccaagcu

SEQ ID NO: 1602 - RNA, 19 nt, Artificial Sequence
  Description of Artificial Sequence: Synthetic oligonucleotide
agcuuggcucucugucuca

SEQ ID NO: 1603 - RNA, 19 nt, Artificial Sequence
  Description of Artificial Sequence: Synthetic oligonucleotide
aagcaccucucagccccuc

SEQ ID NO: 1604 - RNA, 19 nt, Artificial Sequence
  Description of Artificial Sequence: Synthetic oligonucleotide
gaggggcugagaggugcuu

SEQ ID NO: 1605 - RNA, 19 nt, Artificial Sequence
  Description of Artificial Sequence: Synthetic oligonucleotide
uacagcuuuuaagauugua

SEQ ID NO: 1606 - RNA, 19 nt, Artificial Sequence
  Description of Artificial Sequence: Synthetic oligonucleotide
uacaaucuuaaaagcugua

SEQ ID NO: 1607 - RNA, 19 nt, Artificial Sequence
  Description of Artificial Sequence: Synthetic oligonucleotide
cucugucaguggggacguc

SEQ ID NO: 1608 - RNA, 19 nt, Artificial Sequence
  Description of Artificial Sequence: Synthetic oligonucleotide
gacguccccacugacagag

SEQ ID NO: 1609 - RNA, 19 nt, Artificial Sequence
  Description of Artificial Sequence: Synthetic oligonucleotide
cuugccuccaguuuuaggu

SEQ ID NO: 1610 - RNA, 19 nt, Artificial Sequence
  Description of Artificial Sequence: Synthetic oligonucleotide
accuaaaacuggaggcaag

SEQ ID NO: 1611 - RNA, 19 nt, Artificial Sequence
  Description of Artificial Sequence: Synthetic oligonucleotide
cagacugccagagaucgaa

SEQ ID NO: 1612 - RNA, 19 nt, Artificial Sequence
  Description of Artificial Sequence: Synthetic oligonucleotide
uucgaucucuggcagucug

SEQ ID NO: 1613 - RNA, 19 nt, Artificial Sequence
  Description of Artificial Sequence: Synthetic oligonucleotide
caacuuggacccagucaug

SEQ ID NO: 1614 - RNA, 19 nt, Artificial Sequence
  Description of Artificial Sequence: Synthetic oligonucleotide
caugacuggguccaaguug

SEQ ID NO: 1615 - RNA, 19 nt, Artificial Sequence
  Description of Artificial Sequence: Synthetic oligonucleotide
ucucugucaguggggacgu

SEQ ID NO: 1616 - RNA, 19 nt, Artificial Sequence
  Description of Artificial Sequence: Synthetic oligonucleotide
acguccccacugacagaga

SEQ ID NO: 1617 - RNA, 19 nt, Artificial Sequence
  Description of Artificial Sequence: Synthetic oligonucleotide
gaggaagcaccucucagcc

SEQ ID NO: 1618 - RNA, 19 nt, Artificial Sequence
  Description of Artificial Sequence: Synthetic oligonucleotide
ggcugagaggugcuuccuc

SEQ ID NO: 1619 - RNA, 19 nt, Artificial Sequence
  Description of Artificial Sequence: Synthetic oligonucleotide
cccuuuuccuugacuauua

SEQ ID NO: 1620 - RNA, 19 nt, Artificial Sequence
  Description of Artificial Sequence: Synthetic oligonucleotide
uaauagucaaggaaaaggg

SEQ ID NO: 1621 - RNA, 19 nt, Artificial Sequence
  Description of Artificial Sequence: Synthetic oligonucleotide
cauucaaaaagccaaaaua

SEQ ID NO: 1622 - RNA, 19 nt, Artificial Sequence
  Description of Artificial Sequence: Synthetic oligonucleotide
uauuuuggcuuuuugaaug

SEQ ID NO: 1623 - RNA, 19 nt, Artificial Sequence
  Description of Artificial Sequence: Synthetic oligonucleotide
agaaauauuacuauaauug

SEQ ID NO: 1624 - RNA, 19 nt, Artificial Sequence
  Description of Artificial Sequence: Synthetic oligonucleotide
caauuauaguaauauuucu

SEQ ID NO: 1625 - RNA, 19 nt, Artificial Sequence
  Description of Artificial Sequence: Synthetic oligonucleotide
auauuacuauaauugagaa

SEQ ID NO: 1626 - RNA, 19 nt, Artificial Sequence
  Description of Artificial Sequence: Synthetic oligonucleotide
uucucaauuauaguaauau

SEQ ID NO: 1627 - RNA, 19 nt, Artificial Sequence
  Description of Artificial Sequence: Synthetic oligonucleotide
cuaaaauacuuauuaugua

SEQ ID NO: 1628 - RNA, 19 nt, Artificial Sequence
  Description of Artificial Sequence: Synthetic oligonucleotide
uacauaauaaguauuuuag

SEQ ID NO: 1629 - RNA, 19 nt, Artificial Sequence
  Description of Artificial Sequence: Synthetic oligonucleotide
aauacuuauuauguaaggg

SEQ ID NO: 1630 - RNA, 19 nt, Artificial Sequence
  Description of Artificial Sequence: Synthetic oligonucleotide
cccuuacauaauaaguauu

SEQ ID NO: 1631 - RNA, 19 nt, Artificial Sequence
  Description of Artificial Sequence: Synthetic oligonucleotide
ggggcagcccgccuccgcc

SEQ ID NO: 1632 - RNA, 19 nt, Artificial Sequence
  Description of Artificial Sequence: Synthetic oligonucleotide
ggcggaggcgggcugcccc

SEQ ID NO: 1633 - RNA, 19 nt, Artificial Sequence
  Description of Artificial Sequence: Synthetic oligonucleotide
gaacaccugcugagggggc

SEQ ID NO: 1634 - RNA, 19 nt, Artificial Sequence
  Description of Artificial Sequence: Synthetic oligonucleotide
gcccccucagcagguguuc

SEQ ID NO: 1635 - RNA, 19 nt, Artificial Sequence
  Description of Artificial Sequence: Synthetic oligonucleotide
gaucaagaaucuuuuguga

SEQ ID NO: 1636 - RNA, 19 nt, Artificial Sequence
  Description of Artificial Sequence: Synthetic oligonucleotide
ucacaaaagauucuugauc

SEQ ID NO: 1637 - RNA, 19 nt, Artificial Sequence
  Description of Artificial Sequence: Synthetic oligonucleotide
gauggaauuuuuuccugcu

SEQ ID NO: 1638 - RNA, 19 nt, Artificial Sequence
  Description of Artificial Sequence: Synthetic oligonucleotide
agcaggaaaaaauuccauc

SEQ ID NO: 1639 - RNA, 19 nt, Artificial Sequence
  Description of Artificial Sequence: Synthetic oligonucleotide
auggaauuuuuuccugcua

SEQ ID NO: 1640 - RNA, 19 nt, Artificial Sequence
  Description of Artificial Sequence: Synthetic oligonucleotide
uagcaggaaaaaauuccau

SEQ ID NO: 1641 - RNA, 19 nt, Artificial Sequence
  Description of Artificial Sequence: Synthetic oligonucleotide
gaauuuuuuccugcuagug

SEQ ID NO: 1642 - RNA, 19 nt, Artificial Sequence
  Description of Artificial Sequence: Synthetic oligonucleotide
cacuagcaggaaaaaauuc

SEQ ID NO: 1643 - RNA, 19 nt, Artificial Sequence
  Description of Artificial Sequence: Synthetic oligonucleotide
uagcuucugaaaggugcuu

SEQ ID NO: 1644 - RNA, 19 nt, Artificial Sequence
  Description of Artificial Sequence: Synthetic oligonucleotide
aagcaccuuucagaagcua

SEQ ID NO: 1645 - RNA, 19 nt, Artificial Sequence
  Description of Artificial Sequence: Synthetic oligonucleotide
agcuucugaaaggugcuuu

SEQ ID NO: 1646 - RNA, 19 nt, Artificial Sequence
  Description of Artificial Sequence: Synthetic oligonucleotide
aaagcaccuuucagaagcu

SEQ ID NO: 1647 - RNA, 19 nt, Artificial Sequence
  Description of Artificial Sequence: Synthetic oligonucleotide
cccugccgcucauggugcc

SEQ ID NO: 1648 - RNA, 19 nt, Artificial Sequence
  Description of Artificial Sequence: Synthetic oligonucleotide
ggcaccaugagcggcaggg

SEQ ID NO: 1649 - RNA, 19 nt, Artificial Sequence
  Description of Artificial Sequence: Synthetic oligonucleotide
ccugccgcucauggugcca

SEQ ID NO: 1650 - RNA, 19 nt, Artificial Sequence
  Description of Artificial Sequence: Synthetic oligonucleotide
uggcaccaugagcggcagg

SEQ ID NO: 1651 - RNA, 19 nt, Artificial Sequence
  Description of Artificial Sequence: Synthetic oligonucleotide
auggugccagcccagagag

SEQ ID NO: 1652 - RNA, 19 nt, Artificial Sequence
  Description of Artificial Sequence: Synthetic oligonucleotide
cucucugggcuggcaccau

SEQ ID NO: 1653 - RNA, 19 nt, Artificial Sequence
  Description of Artificial Sequence: Synthetic oligonucleotide
ugccagcccagagaggggc

SEQ ID NO: 1654 - RNA, 19 nt, Artificial Sequence
  Description of Artificial Sequence: Synthetic oligonucleotide
gccccucucugggcuggca

SEQ ID NO: 1655 - RNA, 19 nt, Artificial Sequence
  Description of Artificial Sequence: Synthetic oligonucleotide
cgagcggggggcugcccca

SEQ ID NO: 1656 - RNA, 19 nt, Artificial Sequence
  Description of Artificial Sequence: Synthetic oligonucleotide
uggggcagccccccgcucg

SEQ ID NO: 1657 - RNA, 19 nt, Artificial Sequence
  Description of Artificial Sequence: Synthetic oligonucleotide
ccccgaggagaaggcgcug

SEQ ID NO: 1658 - RNA, 19 nt, Artificial Sequence
  Description of Artificial Sequence: Synthetic oligonucleotide
cagcgccuucuccucgggg

SEQ ID NO: 1659 - RNA, 19 nt, Artificial Sequence
  Description of Artificial Sequence: Synthetic oligonucleotide
cgaggagaaggcgcugagg

SEQ ID NO: 1660 - RNA, 19 nt, Artificial Sequence
  Description of Artificial Sequence: Synthetic oligonucleotide
ccucagcgccuucuccucg

SEQ ID NO: 1661 - RNA, 19 nt, Artificial Sequence
  Description of Artificial Sequence: Synthetic oligonucleotide
agaaggcgcugaggaggaa

SEQ ID NO: 1662 - RNA, 19 nt, Artificial Sequence
  Description of Artificial Sequence: Synthetic oligonucleotide
uuccuccucagcgccuucu

SEQ ID NO: 1663 - RNA, 19 nt, Artificial Sequence
  Description of Artificial Sequence: Synthetic oligonucleotide
aggaggaaacugaaaaaca

SEQ ID NO: 1664 - RNA, 19 nt, Artificial Sequence
  Description of Artificial Sequence: Synthetic oligonucleotide
uguuuuucaguuuccuccu

SEQ ID NO: 1665 - RNA, 19 nt, Artificial Sequence
  Description of Artificial Sequence: Synthetic oligonucleotide
agcucagacugccagagau

SEQ ID NO: 1666 - RNA, 19 nt, Artificial Sequence
  Description of Artificial Sequence: Synthetic oligonucleotide
aucucuggcagucugagcu

SEQ ID NO: 1667 - RNA, 19 nt, Artificial Sequence
  Description of Artificial Sequence: Synthetic oligonucleotide
ucagacugccagagaucga

SEQ ID NO: 1668 - RNA, 19 nt, Artificial Sequence
  Description of Artificial Sequence: Synthetic oligonucleotide
ucgaucucuggcagucuga

SEQ ID NO: 1669 - RNA, 19 nt, Artificial Sequence
  Description of Artificial Sequence: Synthetic oligonucleotide
gugagcuggaacagcaagu

SEQ ID NO: 1670 - RNA, 19 nt, Artificial Sequence
  Description of Artificial Sequence: Synthetic oligonucleotide
acuugcuguuccagcucac

SEQ ID NO: 1671 - RNA, 19 nt, Artificial Sequence
  Description of Artificial Sequence: Synthetic oligonucleotide
aagagaaccaaaaacuuuu

SEQ ID NO: 1672 - RNA, 19 nt, Artificial Sequence
  Description of Artificial Sequence: Synthetic oligonucleotide
aaaaguuuuugguucucuu

SEQ ID NO: 1673 - RNA, 19 nt, Artificial Sequence
  Description of Artificial Sequence: Synthetic oligonucleotide
aaaacuuuugcuagaaaau

SEQ ID NO: 1674 - RNA, 19 nt, Artificial Sequence
  Description of Artificial Sequence: Synthetic oligonucleotide
auuuucuagcaaaaguuuu

SEQ ID NO: 1675 - RNA, 19 nt, Artificial Sequence
  Description of Artificial Sequence: Synthetic oligonucleotide
aaacuuuugcuagaaaauc

SEQ ID NO: 1676 - RNA, 19 nt, Artificial Sequence
  Description of Artificial Sequence: Synthetic oligonucleotide
gauuuucuagcaaaaguuu

SEQ ID NO: 1677 - RNA, 19 nt, Artificial Sequence
  Description of Artificial Sequence: Synthetic oligonucleotide
aacuuuugcuagaaaauca

SEQ ID NO: 1678 - RNA, 19 nt, Artificial Sequence
  Description of Artificial Sequence: Synthetic oligonucleotide
ugauuuucuagcaaaaguu

SEQ ID NO: 1679 - RNA, 19 nt, Artificial Sequence
  Description of Artificial Sequence: Synthetic oligonucleotide
uagaaaaucagcuuuuacg

SEQ ID NO: 1680 - RNA, 19 nt, Artificial Sequence
  Description of Artificial Sequence: Synthetic oligonucleotide
cguaaaagcugauuuucua

SEQ ID NO: 1681 - RNA, 19 nt, Artificial Sequence
  Description of Artificial Sequence: Synthetic oligonucleotide
uguaguugagaaccaggag

SEQ ID NO: 1682 - RNA, 19 nt, Artificial Sequence
  Description of Artificial Sequence: Synthetic oligonucleotide
cuccugguucucaacuaca

SEQ ID NO: 1683 - RNA, 19 nt, Artificial Sequence
  Description of Artificial Sequence: Synthetic oligonucleotide
guaguugagaaccaggagu

SEQ ID NO: 1684 - RNA, 19 nt, Artificial Sequence
  Description of Artificial Sequence: Synthetic oligonucleotide
acuccugguucucaacuac

SEQ ID NO: 1685 - RNA, 19 nt, Artificial Sequence
  Description of Artificial Sequence: Synthetic oligonucleotide
aggaggcggaagccaaggg

SEQ ID NO: 1686 - DNA, 19 bp, Artificial Sequence
  Description of Combined DNA/RNA Molecule: Synthetic oligonucleotide
  Description of Artificial Sequence: Synthetic oligonucleotide
cccttggcttccgcctcct

SEQ ID NO: 1687 - RNA, 19 nt, Artificial Sequence
  Description of Artificial Sequence: Synthetic oligonucleotide
gaggcggaagccaagggga

SEQ ID NO: 1688 - DNA, 19 bp, Artificial Sequence
  Description of Combined DNA/RNA Molecule: Synthetic oligonucleotide
  Description of Artificial Sequence: Synthetic oligonucleotide
tccccttggcttccgcctc

SEQ ID NO: 1689 - RNA, 19 nt, Artificial Sequence
  Description of Artificial Sequence: Synthetic oligonucleotide
aggcggaagccaaggggaa

SEQ ID NO: 1690 - DNA, 19 bp, Artificial Sequence
  Description of Combined DNA/RNA Molecule: Synthetic oligonucleotide
  Description of Artificial Sequence: Synthetic oligonucleotide
ttccccttggcttccgcct

SEQ ID NO: 1691 - RNA, 19 nt, Artificial Sequence
  Description of Artificial Sequence: Synthetic oligonucleotide
gugaggccaguggccgggu

SEQ ID NO: 1692 - RNA, 19 nt, Artificial Sequence
  Description of Artificial Sequence: Synthetic oligonucleotide
acccggccacuggccucac

SEQ ID NO: 1693 - RNA, 19 nt, Artificial Sequence
  Description of Artificial Sequence: Synthetic oligonucleotide
gggucugcugaguccgcag

SEQ ID NO: 1694 - RNA, 19 nt, Artificial Sequence
  Description of Artificial Sequence: Synthetic oligonucleotide
cugcggacucagcagaccc

SEQ ID NO: 1695 - RNA, 19 nt, Artificial Sequence
  Description of Artificial Sequence: Synthetic oligonucleotide
ugcaggcccaguugucacc

SEQ ID NO: 1696 - RNA, 19 nt, Artificial Sequence
  Description of Artificial Sequence: Synthetic oligonucleotide
ggugacaacugggccugca

SEQ ID NO: 1697 - RNA, 19 nt, Artificial Sequence
  Description of Artificial Sequence: Synthetic oligonucleotide
cccuccagaacaucucccc

SEQ ID NO: 1698 - RNA, 19 nt, Artificial Sequence
  Description of Artificial Sequence: Synthetic oligonucleotide
ggggagauguucuggaggg

SEQ ID NO: 1699 - RNA, 19 nt, Artificial Sequence
  Description of Artificial Sequence: Synthetic oligonucleotide
cuccagaacaucuccccau

SEQ ID NO: 1700 - RNA, 19 nt, Artificial Sequence
  Description of Artificial Sequence: Synthetic oligonucleotide
auggggagauguucuggag

SEQ ID NO: 1701 - RNA, 19 nt, Artificial Sequence
  Description of Artificial Sequence: Synthetic oligonucleotide
auccuguugggcauucugg

SEQ ID NO: 1702 - RNA, 19 nt, Artificial Sequence
  Description of Artificial Sequence: Synthetic oligonucleotide
ccagaaugcccaacaggau

SEQ ID NO: 1703 - RNA, 19 nt, Artificial Sequence
  Description of Artificial Sequence: Synthetic oligonucleotide
aacuuggacccagucaugu

SEQ ID NO: 1704 - RNA, 19 nt, Artificial Sequence
  Description of Artificial Sequence: Synthetic oligonucleotide
acaugacuggguccaaguu

SEQ ID NO: 1705 - RNA, 19 nt, Artificial Sequence
  Description of Artificial Sequence: Synthetic oligonucleotide
cccagucauguucuucaaa

SEQ ID NO: 1706 - RNA, 19 nt, Artificial Sequence
  Description of Artificial Sequence: Synthetic oligonucleotide
uuugaagaacaugacuggg

SEQ ID NO: 1707 - RNA, 19 nt, Artificial Sequence
  Description of Artificial Sequence: Synthetic oligonucleotide
ccagucauguucuucaaau

SEQ ID NO: 1708 - RNA, 19 nt, Artificial Sequence
  Description of Artificial Sequence: Synthetic oligonucleotide
auuugaagaacaugacugg

SEQ ID NO: 1709 - RNA, 19 nt, Artificial Sequence
  Description of Artificial Sequence: Synthetic oligonucleotide
uucuucaaaugcccuuccc

SEQ ID NO: 1710 - RNA, 19 nt, Artificial Sequence
  Description of Artificial Sequence: Synthetic oligonucleotide
gggaagggcauuugaagaa

SEQ ID NO: 1711 - RNA, 19 nt, Artificial Sequence
  Description of Artificial Sequence: Synthetic oligonucleotide
ucuucaaaugcccuucccc

SEQ ID NO: 1712 - RNA, 19 nt, Artificial Sequence
  Description of Artificial Sequence: Synthetic oligonucleotide
ggggaagggcauuugaaga

SEQ ID NO: 1713 - RNA, 19 nt, Artificial Sequence
  Description of Artificial Sequence: Synthetic oligonucleotide
cuggaggagcucccagagg

SEQ ID NO: 1714 - RNA, 19 nt, Artificial Sequence
  Description of Artificial Sequence: Synthetic oligonucleotide
ccucugggagcuccuccag

SEQ ID NO: 1715 - RNA, 19 nt, Artificial Sequence
  Description of Artificial Sequence: Synthetic oligonucleotide
gucuacccagaaggaccca

SEQ ID NO: 1716 - RNA, 19 nt, Artificial Sequence
  Description of Artificial Sequence: Synthetic oligonucleotide
uggguccuucuggguagac

SEQ ID NO: 1717 - RNA, 19 nt, Artificial Sequence
  Description of Artificial Sequence: Synthetic oligonucleotide
uccuuaccagccucccuuu

SEQ ID NO: 1718 - RNA, 19 nt, Artificial Sequence
  Description of Artificial Sequence: Synthetic oligonucleotide
aaagggaggcugguaagga

SEQ ID NO: 1719 - RNA, 19 nt, Artificial Sequence
  Description of Artificial Sequence: Synthetic oligonucleotide
uuaccagccucccuuucuc

SEQ ID NO: 1720 - RNA, 19 nt, Artificial Sequence
  Description of Artificial Sequence: Synthetic oligonucleotide
gagaaagggaggcugguaa

SEQ ID NO: 1721 - RNA, 19 nt, Artificial Sequence
  Description of Artificial Sequence: Synthetic oligonucleotide
ucccuuucucugucagugg

SEQ ID NO: 1722 - RNA, 19 nt, Artificial Sequence
  Description of Artificial Sequence: Synthetic oligonucleotide
ccacugacagagaaaggga

SEQ ID NO: 1723 - RNA, 19 nt, Artificial Sequence
  Description of Artificial Sequence: Synthetic oligonucleotide
caucagccaagcuggaagc

SEQ ID NO: 1724 - RNA, 19 nt, Artificial Sequence
  Description of Artificial Sequence: Synthetic oligonucleotide
gcuuccagcuuggcugaug

SEQ ID NO: 1725 - RNA, 19 nt, Artificial Sequence
  Description of Artificial Sequence: Synthetic oligonucleotide
uacccucugagacagagag

SEQ ID NO: 1726 - RNA, 19 nt, Artificial Sequence
  Description of Artificial Sequence: Synthetic oligonucleotide
cucucugucucagagggua

SEQ ID NO: 1727 - RNA, 19 nt, Artificial Sequence
  Description of Artificial Sequence: Synthetic oligonucleotide
acccucugagacagagagc

SEQ ID NO: 1728 - RNA, 19 nt, Artificial Sequence
  Description of Artificial Sequence: Synthetic oligonucleotide
gcucucugucucagagggu

SEQ ID NO: 1729 - RNA, 19 nt, Artificial Sequence
  Description of Artificial Sequence: Synthetic oligonucleotide
gagacagagagccaagcua

SEQ ID NO: 1730 - RNA, 19 nt, Artificial Sequence
  Description of Artificial Sequence: Synthetic oligonucleotide
uagcuuggcucucugucuc

SEQ ID NO: 1731 - RNA, 19 nt, Artificial Sequence
  Description of Artificial Sequence: Synthetic oligonucleotide
agacagagagccaagcuaa

SEQ ID NO: 1732 - RNA, 19 nt, Artificial Sequence
  Description of Artificial Sequence: Synthetic oligonucleotide
uuagcuuggcucucugucu

SEQ ID NO: 1733 - RNA, 19 nt, Artificial Sequence
  Description of Artificial Sequence: Synthetic oligonucleotide
auugucucagugaaggaag

SEQ ID NO: 1734 - RNA, 19 nt, Artificial Sequence
  Description of Artificial Sequence: Synthetic oligonucleotide
cuuccuucacugagacaau

SEQ ID NO: 1735 - RNA, 19 nt, Artificial Sequence
  Description of Artificial Sequence: Synthetic oligonucleotide
gucucagugaaggaagaac

SEQ ID NO: 1736 - RNA, 19 nt, Artificial Sequence
  Description of Artificial Sequence: Synthetic oligonucleotide
guucuuccuucacugagac

SEQ ID NO: 1737 - RNA, 19 nt, Artificial Sequence
  Description of Artificial Sequence: Synthetic oligonucleotide
cacugccuggaggauagca

SEQ ID NO: 1738 - RNA, 19 nt, Artificial Sequence
  Description of Artificial Sequence: Synthetic oligonucleotide
ugcuauccuccaggcagug

SEQ ID NO: 1739 - RNA, 19 nt, Artificial Sequence
  Description of Artificial Sequence: Synthetic oligonucleotide
aauuuuuuccugcuagugu

SEQ ID NO: 1740 - RNA, 19 nt, Artificial Sequence
  Description of Artificial Sequence: Synthetic oligonucleotide
acacuagcaggaaaaaauu

SEQ ID NO: 1741 - RNA, 19 nt, Artificial Sequence
  Description of Artificial Sequence: Synthetic oligonucleotide
aggcagcgagcggggggcu

SEQ ID NO: 1742 - RNA, 19 nt, Artificial Sequence
  Description of Artificial Sequence: Synthetic oligonucleotide
agccccccgcucgcugccu

SEQ ID NO: 1743 - RNA, 19 nt, Artificial Sequence
  Description of Artificial Sequence: Synthetic oligonucleotide
ggcugccccaggcgcgcaa

SEQ ID NO: 1744 - RNA, 19 nt, Artificial Sequence
  Description of Artificial Sequence: Synthetic oligonucleotide
uugcgcgccuggggcagcc

SEQ ID NO: 1745 - RNA, 19 nt, Artificial Sequence
  Description of Artificial Sequence: Synthetic oligonucleotide
ugaggaggaaacugaaaaa

SEQ ID NO: 1746 - RNA, 19 nt, Artificial Sequence
  Description of Artificial Sequence: Synthetic oligonucleotide
uuuuucaguuuccuccuca

SEQ ID NO: 1747 - RNA, 19 nt, Artificial Sequence
  Description of Artificial Sequence: Synthetic oligonucleotide
uaaugugguagugaaaauc

SEQ ID NO: 1748 - RNA, 19 nt, Artificial Sequence
  Description of Artificial Sequence: Synthetic oligonucleotide
gauuuucacuaccacauua

SEQ ID NO: 1749 - RNA, 19 nt, Artificial Sequence
  Description of Artificial Sequence: Synthetic oligonucleotide
ugguggugguggcagccgc

SEQ ID NO: 1750 - RNA, 19 nt, Artificial Sequence
  Description of Artificial Sequence: Synthetic oligonucleotide
gcggcugccaccaccacca

SEQ ID NO: 1751 - RNA, 19 nt, Artificial Sequence
  Description of Artificial Sequence: Synthetic oligonucleotide
gguaucucaaaucugcuuu

SEQ ID NO: 1752 - RNA, 19 nt, Artificial Sequence
  Description of Artificial Sequence: Synthetic oligonucleotide
aaagcagauuugagauacc

SEQ ID NO: 1753 - RNA, 19 nt, Artificial Sequence
  Description of Artificial Sequence: Synthetic oligonucleotide
ucucaaaucugcuuucauc

SEQ ID NO: 1754 - RNA, 19 nt, Artificial Sequence
  Description of Artificial Sequence: Synthetic oligonucleotide
gaugaaagcagauuugaga

SEQ ID NO: 1755 - RNA, 19 nt, Artificial Sequence
  Description of Artificial Sequence: Synthetic oligonucleotide
cucaaaucugcuuucaucc

SEQ ID NO: 1756 - RNA, 19 nt, Artificial Sequence
  Description of Artificial Sequence: Synthetic oligonucleotide
ggaugaaagcagauuugag

SEQ ID NO: 1757 - RNA, 19 nt, Artificial Sequence
  Description of Artificial Sequence: Synthetic oligonucleotide
uccugccuacuggaugcuu

SEQ ID NO: 1758 - RNA, 19 nt, Artificial Sequence
  Description of Artificial Sequence: Synthetic oligonucleotide
aagcauccaguaggcagga

SEQ ID NO: 1759 - RNA, 19 nt, Artificial Sequence
  Description of Artificial Sequence: Synthetic oligonucleotide
gaugcuuacagugacugug

SEQ ID NO: 1760 - RNA, 19 nt, Artificial Sequence
  Description of Artificial Sequence: Synthetic oligonucleotide
cacagucacuguaagcauc

SEQ ID NO: 1761 - RNA, 19 nt, Artificial Sequence
  Description of Artificial Sequence: Synthetic oligonucleotide
uucagugacauguccucuc

SEQ ID NO: 1762 - RNA, 19 nt, Artificial Sequence
  Description of Artificial Sequence: Synthetic oligonucleotide
gagaggacaugucacugaa

SEQ ID NO: 1763 - RNA, 19 nt, Artificial Sequence
  Description of Artificial Sequence: Synthetic oligonucleotide
cauucuugggaggacacuu

SEQ ID NO: 1764 - RNA, 19 nt, Artificial Sequence
  Description of Artificial Sequence: Synthetic oligonucleotide
aaguguccucccaagaaug

SEQ ID NO: 1765 - RNA, 19 nt, Artificial Sequence
  Description of Artificial Sequence: Synthetic oligonucleotide
auucuugggaggacacuuu

SEQ ID NO: 1766 - RNA, 19 nt, Artificial Sequence
  Description of Artificial Sequence: Synthetic oligonucleotide
aaaguguccucccaagaau

SEQ ID NO: 1767 - RNA, 19 nt, Artificial Sequence
  Description of Artificial Sequence: Synthetic oligonucleotide
gacacuuuugccaaugaac

SEQ ID NO: 1768 - RNA, 19 nt, Artificial Sequence
  Description of Artificial Sequence: Synthetic oligonucleotide
guucauuggcaaaaguguc

SEQ ID NO: 1769 - RNA, 19 nt, Artificial Sequence
  Description of Artificial Sequence: Synthetic oligonucleotide
uugcccuuuuccuugacua

SEQ ID NO: 1770 - RNA, 19 nt, Artificial Sequence
  Description of Artificial Sequence: Synthetic oligonucleotide
uagucaaggaaaagggcaa

SEQ ID NO: 1771 - RNA, 19 nt, Artificial Sequence
  Description of Artificial Sequence: Synthetic oligonucleotide
cuucauucaaaaagccaaa

SEQ ID NO: 1772 - RNA, 19 nt, Artificial Sequence
  Description of Artificial Sequence: Synthetic oligonucleotide
uuuggcuuuuugaaugaag

SEQ ID NO: 1773 - RNA, 19 nt, Artificial Sequence
  Description of Artificial Sequence: Synthetic oligonucleotide
uucauucaaaaagccaaaa

SEQ ID NO: 1774 - RNA, 19 nt, Artificial Sequence
  Description of Artificial Sequence: Synthetic oligonucleotide
uuuuggcuuuuugaaugaa

SEQ ID NO: 1775 - RNA, 19 nt, Artificial Sequence
  Description of Artificial Sequence: Synthetic oligonucleotide
auucaaaaagccaaaauag

SEQ ID NO: 1776 - RNA, 19 nt, Artificial Sequence
  Description of Artificial Sequence: Synthetic oligonucleotide
cuauuuuggcuuuuugaau

SEQ ID NO: 1777 - RNA, 19 nt, Artificial Sequence
  Description of Artificial Sequence: Synthetic oligonucleotide
ucaaaaagccaaaauagag

SEQ ID NO: 1778 - RNA, 19 nt, Artificial Sequence
  Description of Artificial Sequence: Synthetic oligonucleotide
cucuauuuuggcuuuuuga

SEQ ID NO: 1779 - RNA, 19 nt, Artificial Sequence
  Description of Artificial Sequence: Synthetic oligonucleotide
aaaaagccaaaauagagag

SEQ ID NO: 1780 - RNA, 19 nt, Artificial Sequence
  Description of Artificial Sequence: Synthetic oligonucleotide
cucucuauuuuggcuuuuu

SEQ ID NO: 1781 - RNA, 19 nt, Artificial Sequence
  Description of Artificial Sequence: Synthetic oligonucleotide
ugucuuuugacauccagca

SEQ ID NO: 1782 - RNA, 19 nt, Artificial Sequence
  Description of Artificial Sequence: Synthetic oligonucleotide
ugcuggaugucaaaagaca

SEQ ID NO: 1783 - RNA, 19 nt, Artificial Sequence
  Description of Artificial Sequence: Synthetic oligonucleotide
gaaauauuacuauaauuga

SEQ ID NO: 1784 - RNA, 19 nt, Artificial Sequence
  Description of Artificial Sequence: Synthetic oligonucleotide
ucaauuauaguaauauuuc

SEQ ID NO: 1785 - RNA, 19 nt, Artificial Sequence
  Description of Artificial Sequence: Synthetic oligonucleotide
uauuacuauaauugagaac

SEQ ID NO: 1786 - RNA, 19 nt, Artificial Sequence
  Description of Artificial Sequence: Synthetic oligonucleotide
guucucaauuauaguaaua

SEQ ID NO: 1787 - RNA, 19 nt, Artificial Sequence
  Description of Artificial Sequence: Synthetic oligonucleotide
gagaacuacagcuuuuaag

SEQ ID NO: 1788 - RNA, 19 nt, Artificial Sequence
  Description of Artificial Sequence: Synthetic oligonucleotide
cuuaaaagcuguaguucuc

SEQ ID NO: 1789 - RNA, 19 nt, Artificial Sequence
  Description of Artificial Sequence: Synthetic oligonucleotide
gauuguacuuuuaucuuaa

SEQ ID NO: 1790 - RNA, 19 nt, Artificial Sequence
  Description of Artificial Sequence: Synthetic oligonucleotide
uuaagauaaaaguacaauc

SEQ ID NO: 1791 - RNA, 19 nt, Artificial Sequence
  Description of Artificial Sequence: Synthetic oligonucleotide
ucugucggggcagcccgcc

SEQ ID NO: 1792 - RNA, 19 nt, Artificial Sequence
  Description of Artificial Sequence: Synthetic oligonucleotide
ggcgggcugccccgacaga

SEQ ID NO: 1793 - RNA, 19 nt, Artificial Sequence
  Description of Artificial Sequence: Synthetic oligonucleotide
uguacuuuuaucuuaaaag

SEQ ID NO: 1794 - RNA, 19 nt, Artificial Sequence
  Description of Artificial Sequence: Synthetic oligonucleotide
cuuuuaagauaaaaguaca

SEQ ID NO: 1795 - RNA, 19 nt, Artificial Sequence
  Description of Artificial Sequence: Synthetic oligonucleotide
gggcagcccgccuccgccg

SEQ ID NO: 1796 - RNA, 19 nt, Artificial Sequence
  Description of Artificial Sequence: Synthetic oligonucleotide
cggcggaggcgggcugccc

SEQ ID NO: 1797 - RNA, 19 nt, Artificial Sequence
  Description of Artificial Sequence: Synthetic oligonucleotide
ggcagcccgccuccgccgc

SEQ ID NO: 1798 - RNA, 19 nt, Artificial Sequence
  Description of Artificial Sequence: Synthetic oligonucleotide
gcggcggaggcgggcugcc

SEQ ID NO: 1799 - RNA, 19 nt, Artificial Sequence
  Description of Artificial Sequence: Synthetic oligonucleotide
auuuaugaaugguucuuua

SEQ ID NO: 1800 - RNA, 19 nt, Artificial Sequence
  Description of Artificial Sequence: Synthetic oligonucleotide
uaaagaaccauucauaaau

SEQ ID NO: 1801 - RNA, 19 nt, Artificial Sequence
  Description of Artificial Sequence: Synthetic oligonucleotide
uuuaugaaugguucuuuau

SEQ ID NO: 1802 - RNA, 19 nt, Artificial Sequence
  Description of Artificial Sequence: Synthetic oligonucleotide
auaaagaaccauucauaaa

SEQ ID NO: 1803 - RNA, 19 nt, Artificial Sequence
  Description of Artificial Sequence: Synthetic oligonucleotide
cuuuaucauuucucuuccc

SEQ ID NO: 1804 - RNA, 19 nt, Artificial Sequence
  Description of Artificial Sequence: Synthetic oligonucleotide
gggaagagaaaugauaaag

SEQ ID NO: 1805 - RNA, 19 nt, Artificial Sequence
  Description of Artificial Sequence: Synthetic oligonucleotide
cagcccgccuccgccgccg

SEQ ID NO: 1806 - RNA, 19 nt, Artificial Sequence
  Description of Artificial Sequence: Synthetic oligonucleotide
cggcggcggaggcgggcug

SEQ ID NO: 1807 - RNA, 19 nt, Artificial Sequence
  Description of Artificial Sequence: Synthetic oligonucleotide
auuucucuucccccuuuuu

SEQ ID NO: 1808 - RNA, 19 nt, Artificial Sequence
  Description of Artificial Sequence: Synthetic oligonucleotide
aaaaagggggaagagaaau

SEQ ID NO: 1809 - RNA, 19 nt, Artificial Sequence
  Description of Artificial Sequence: Synthetic oligonucleotide
ucccccuuuuuggcauccu

SEQ ID NO: 1810 - RNA, 19 nt, Artificial Sequence
  Description of Artificial Sequence: Synthetic oligonucleotide
aggaugccaaaaaggggga

SEQ ID NO: 1811 - RNA, 19 nt, Artificial Sequence
  Description of Artificial Sequence: Synthetic oligonucleotide
cccuuuuuggcauccuggc

SEQ ID NO: 1812 - RNA, 19 nt, Artificial Sequence
  Description of Artificial Sequence: Synthetic oligonucleotide
gccaggaugccaaaaaggg

SEQ ID NO: 1813 - RNA, 19 nt, Artificial Sequence
  Description of Artificial Sequence: Synthetic oligonucleotide
ccuuuuuggcauccuggcu

SEQ ID NO: 1814 - RNA, 19 nt, Artificial Sequence
  Description of Artificial Sequence: Synthetic oligonucleotide
agccaggaugccaaaaagg

SEQ ID NO: 1815 - RNA, 19 nt, Artificial Sequence
  Description of Artificial Sequence: Synthetic oligonucleotide
gcccgccuccgccgccgga

SEQ ID NO: 1816 - RNA, 19 nt, Artificial Sequence
  Description of Artificial Sequence: Synthetic oligonucleotide
uccggcggcggaggcgggc

SEQ ID NO: 1817 - RNA, 19 nt, Artificial Sequence
  Description of Artificial Sequence: Synthetic oligonucleotide
uggcauccuggcuugccuc

SEQ ID NO: 1818 - RNA, 19 nt, Artificial Sequence
  Description of Artificial Sequence: Synthetic oligonucleotide
gaggcaagccaggaugcca

SEQ ID NO: 1819 - RNA, 19 nt, Artificial Sequence
  Description of Artificial Sequence: Synthetic oligonucleotide
uccuggcuugccuccaguu

SEQ ID NO: 1820 - RNA, 19 nt, Artificial Sequence
  Description of Artificial Sequence: Synthetic oligonucleotide
aacuggaggcaagccagga

SEQ ID NO: 1821 - RNA, 19 nt, Artificial Sequence
  Description of Artificial Sequence: Synthetic oligonucleotide
cccgccuccgccgccggag

SEQ ID NO: 1822 - RNA, 19 nt, Artificial Sequence
  Description of Artificial Sequence: Synthetic oligonucleotide
cuccggcggcggaggcggg

SEQ ID NO: 1823 - RNA, 19 nt, Artificial Sequence
  Description of Artificial Sequence: Synthetic oligonucleotide
ccgccuccgccgccggagc

SEQ ID NO: 1824 - RNA, 19 nt, Artificial Sequence
  Description of Artificial Sequence: Synthetic oligonucleotide
gcuccggcggcggaggcgg

SEQ ID NO: 1825 - RNA, 19 nt, Artificial Sequence
  Description of Artificial Sequence: Synthetic oligonucleotide
cgccuccgccgccggagcc

SEQ ID NO: 1826 - RNA, 19 nt, Artificial Sequence
  Description of Artificial Sequence: Synthetic oligonucleotide
ggcuccggcggcggaggcg

SEQ ID NO: 1827 - RNA, 19 nt, Artificial Sequence
  Description of Artificial Sequence: Synthetic oligonucleotide
uccgccgccggagccccgg

SEQ ID NO: 1828 - RNA, 19 nt, Artificial Sequence
  Description of Artificial Sequence: Synthetic oligonucleotide
ccggggcuccggcggcgga

SEQ ID NO: 1829 - RNA, 19 nt, Artificial Sequence
  Description of Artificial Sequence: Synthetic oligonucleotide
cgccgccggagccccggcc

SEQ ID NO: 1830 - DNA, 19 bp, Artificial Sequence
  Description of Combined DNA/RNA Molecule: Synthetic oligonucleotide
  Description of Artificial Sequence: Synthetic oligonucleotide
ggccggggctccggcggcg

SEQ ID NO: 1831 - RNA, 19 nt, Artificial Sequence
  Description of Artificial Sequence: Synthetic oligonucleotide
uucaaguaagaucaagaau

SEQ ID NO: 1832 - RNA, 19 nt, Artificial Sequence
  Description of Artificial Sequence: Synthetic oligonucleotide
auucuugaucuuacuugaa

SEQ ID NO: 1833 - RNA, 19 nt, Artificial Sequence
  Description of Artificial Sequence: Synthetic oligonucleotide
gccgccggagccccggccg

SEQ ID NO: 1834 - DNA, 19 bp, Artificial Sequence
  Description of Combined DNA/RNA Molecule: Synthetic oligonucleotide
  Description of Artificial Sequence: Synthetic oligonucleotide
cggccggggctccggcggc

SEQ ID NO: 1835 - RNA, 19 nt, Artificial Sequence
  Description of Artificial Sequence: Synthetic oligonucleotide
cgccggagccccggccggc

SEQ ID NO: 1836 - DNA, 19 bp, Artificial Sequence
  Description of Combined DNA/RNA Molecule: Synthetic oligonucleotide
  Description of Artificial Sequence: Synthetic oligonucleotide
gccggccggggctccggcg

SEQ ID NO: 1837 - RNA, 19 nt, Artificial Sequence
  Description of Artificial Sequence: Synthetic oligonucleotide
gccggagccccggccggcc

SEQ ID NO: 1838 - DNA, 19 bp, Artificial Sequence
  Description of Combined DNA/RNA Molecule: Synthetic oligonucleotide
  Description of Artificial Sequence: Synthetic oligonucleotide
ggccggccggggctccggc

SEQ ID NO: 1839 - RNA, 19 nt, Artificial Sequence
  Description of Artificial Sequence: Synthetic oligonucleotide
ccggagccccggccggcca

SEQ ID NO: 1840 - DNA, 19 bp, Artificial Sequence
  Description of Combined DNA/RNA Molecule: Synthetic oligonucleotide
  Description of Artificial Sequence: Synthetic oligonucleotide
tggccggccggggctccgg

SEQ ID NO: 1841 - RNA, 19 nt, Artificial Sequence
  Description of Artificial Sequence: Synthetic oligonucleotide
uauguaaaugcuugaugga

SEQ ID NO: 1842 - RNA, 19 nt, Artificial Sequence
  Description of Artificial Sequence: Synthetic oligonucleotide
uccaucaagcauuuacaua

SEQ ID NO: 1843 - RNA, 19 nt, Artificial Sequence
  Description of Artificial Sequence: Synthetic oligonucleotide
uaaaugcuugauggaauuu

SEQ ID NO: 1844 - RNA, 19 nt, Artificial Sequence
  Description of Artificial Sequence: Synthetic oligonucleotide
aaauuccaucaagcauuua

SEQ ID NO: 1845 - RNA, 19 nt, Artificial Sequence
  Description of Artificial Sequence: Synthetic oligonucleotide
cggagccccggccggccag

SEQ ID NO: 1846 - DNA, 19 bp, Artificial Sequence
  Description of Combined DNA/RNA Molecule: Synthetic oligonucleotide
  Description of Artificial Sequence: Synthetic oligonucleotide
ctggccggccggggctccg

SEQ ID NO: 1847 - RNA, 19 nt, Artificial Sequence
  Description of Artificial Sequence: Synthetic oligonucleotide
ggagccccggccggccagg

SEQ ID NO: 1848 - DNA, 19 bp, Artificial Sequence
  Description of Combined DNA/RNA Molecule: Synthetic oligonucleotide
  Description of Artificial Sequence: Synthetic oligonucleotide
cctggccggccggggctcc

SEQ ID NO: 1849 - RNA, 19 nt, Artificial Sequence
  Description of Artificial Sequence: Synthetic oligonucleotide
gagccccggccggccaggc

SEQ ID NO: 1850 - DNA, 19 bp, Artificial Sequence
  Description of Combined DNA/RNA Molecule: Synthetic oligonucleotide
  Description of Artificial Sequence: Synthetic oligonucleotide
gcctggccggccggggctc

SEQ ID NO: 1851 - RNA, 19 nt, Artificial Sequence
  Description of Artificial Sequence: Synthetic oligonucleotide
gccccggccggccaggccc

SEQ ID NO: 1852 - DNA, 19 bp, Artificial Sequence
  Description of Combined DNA/RNA Molecule: Synthetic oligonucleotide
  Description of Artificial Sequence: Synthetic oligonucleotide
gggcctggccggccggggc

SEQ ID NO: 1853 - RNA, 19 nt, Artificial Sequence
  Description of Artificial Sequence: Synthetic oligonucleotide
uccauuuauuuaaaacuac

SEQ ID NO: 1854 - RNA, 19 nt, Artificial Sequence
  Description of Artificial Sequence: Synthetic oligonucleotide
guaguuuuaaauaaaugga

SEQ ID NO: 1855 - RNA, 19 nt, Artificial Sequence
  Description of Artificial Sequence: Synthetic oligonucleotide
ccccggccggccaggcccu

SEQ ID NO: 1856 - RNA, 19 nt, Artificial Sequence
  Description of Artificial Sequence: Synthetic oligonucleotide
agggccuggccggccgggg

SEQ ID NO: 1857 - RNA, 19 nt, Artificial Sequence
  Description of Artificial Sequence: Synthetic oligonucleotide
ccggccggccaggcccugc

SEQ ID NO: 1858 - RNA, 19 nt, Artificial Sequence
  Description of Artificial Sequence: Synthetic oligonucleotide
gcagggccuggccggccgg

SEQ ID NO: 1859 - RNA, 19 nt, Artificial Sequence
  Description of Artificial Sequence: Synthetic oligonucleotide
cggccggccaggcccugcc

SEQ ID NO: 1860 - RNA, 19 nt, Artificial Sequence
  Description of Artificial Sequence: Synthetic oligonucleotide
ggcagggccuggccggccg

SEQ ID NO: 1861 - RNA, 19 nt, Artificial Sequence
  Description of Artificial Sequence: Synthetic oligonucleotide
ggccggccaggcccugccg

SEQ ID NO: 1862 - RNA, 19 nt, Artificial Sequence
  Description of Artificial Sequence: Synthetic oligonucleotide
cggcagggccuggccggcc

SEQ ID NO: 1863 - RNA, 19 nt, Artificial Sequence
  Description of Artificial Sequence: Synthetic oligonucleotide
gccggccaggcccugccgc

SEQ ID NO: 1864 - RNA, 19 nt, Artificial Sequence
  Description of Artificial Sequence: Synthetic oligonucleotide
gcggcagggccuggccggc

SEQ ID NO: 1865 - RNA, 19 nt, Artificial Sequence
  Description of Artificial Sequence: Synthetic oligonucleotide
ccggccaggcccugccgcu

SEQ ID NO: 1866 - RNA, 19 nt, Artificial Sequence
  Description of Artificial Sequence: Synthetic oligonucleotide
agcggcagggccuggccgg

SEQ ID NO: 1867 - RNA, 19 nt, Artificial Sequence
  Description of Artificial Sequence: Synthetic oligonucleotide
cggccaggcccugccgcuc

SEQ ID NO: 1868 - RNA, 19 nt, Artificial Sequence
  Description of Artificial Sequence: Synthetic oligonucleotide
gagcggcagggccuggccg

SEQ ID NO: 1869 - RNA, 19 nt, Artificial Sequence
  Description of Artificial Sequence: Synthetic oligonucleotide
ucauggugccagcccagag

SEQ ID NO: 1870 - RNA, 19 nt, Artificial Sequence
  Description of Artificial Sequence: Synthetic oligonucleotide
cucugggcuggcaccauga

SEQ ID NO: 1871 - RNA, 19 nt, Artificial Sequence
  Description of Artificial Sequence: Synthetic oligonucleotide
cauggugccagcccagaga

SEQ ID NO: 1872 - RNA, 19 nt, Artificial Sequence
  Description of Artificial Sequence: Synthetic oligonucleotide
ucucugggcuggcaccaug

SEQ ID NO: 1873 - RNA, 19 nt, Artificial Sequence
  Description of Artificial Sequence: Synthetic oligonucleotide
uggugccagcccagagagg

SEQ ID NO: 1874 - RNA, 19 nt, Artificial Sequence
  Description of Artificial Sequence: Synthetic oligonucleotide
ccucucugggcuggcacca

SEQ ID NO: 1875 - RNA, 19 nt, Artificial Sequence
  Description of Artificial Sequence: Synthetic oligonucleotide
ggugccagcccagagaggg

SEQ ID NO: 1876 - RNA, 19 nt, Artificial Sequence
  Description of Artificial Sequence: Synthetic oligonucleotide
cccucucugggcuggcacc

SEQ ID NO: 1877 - RNA, 19 nt, Artificial Sequence
  Description of Artificial Sequence: Synthetic oligonucleotide
gugccagcccagagagggg

SEQ ID NO: 1878 - RNA, 19 nt, Artificial Sequence
  Description of Artificial Sequence: Synthetic oligonucleotide
ccccucucugggcuggcac

SEQ ID NO: 1879 - RNA, 19 nt, Artificial Sequence
  Description of Artificial Sequence: Synthetic oligonucleotide
gagcggggggcugccccag

SEQ ID NO: 1880 - RNA, 19 nt, Artificial Sequence
  Description of Artificial Sequence: Synthetic oligonucleotide
cuggggcagccccccgcuc

SEQ ID NO: 1881 - RNA, 19 nt, Artificial Sequence
  Description of Artificial Sequence: Synthetic oligonucleotide
agcggggggcugccccagg

SEQ ID NO: 1882 - RNA, 19 nt, Artificial Sequence
  Description of Artificial Sequence: Synthetic oligonucleotide
ccuggggcagccccccgcu

SEQ ID NO: 1883 - RNA, 19 nt, Artificial Sequence
  Description of Artificial Sequence: Synthetic oligonucleotide
gcggggggcugccccaggc

SEQ ID NO: 1884 - RNA, 19 nt, Artificial Sequence
  Description of Artificial Sequence: Synthetic oligonucleotide
gccuggggcagccccccgc

SEQ ID NO: 1885 - RNA, 19 nt, Artificial Sequence
  Description of Artificial Sequence: Synthetic oligonucleotide
cggggggcugccccaggcg

SEQ ID NO: 1886 - RNA, 19 nt, Artificial Sequence
  Description of Artificial Sequence: Synthetic oligonucleotide
cgccuggggcagccccccg

SEQ ID NO: 1887 - RNA, 19 nt, Artificial Sequence
  Description of Artificial Sequence: Synthetic oligonucleotide
gggcugccccaggcgcgca

SEQ ID NO: 1888 - RNA, 19 nt, Artificial Sequence
  Description of Artificial Sequence: Synthetic oligonucleotide
ugcgcgccuggggcagccc

SEQ ID NO: 1889 - RNA, 19 nt, Artificial Sequence
  Description of Artificial Sequence: Synthetic oligonucleotide
ugccccaggcgcgcaagcg

SEQ ID NO: 1890 - RNA, 19 nt, Artificial Sequence
  Description of Artificial Sequence: Synthetic oligonucleotide
cgcuugcgcgccuggggca

SEQ ID NO: 1891 - RNA, 19 nt, Artificial Sequence
  Description of Artificial Sequence: Synthetic oligonucleotide
ugagccccgaggagaaggc

SEQ ID NO: 1892 - RNA, 19 nt, Artificial Sequence
  Description of Artificial Sequence: Synthetic oligonucleotide
gccuucuccucggggcuca

SEQ ID NO: 1893 - RNA, 19 nt, Artificial Sequence
  Description of Artificial Sequence: Synthetic oligonucleotide
gccccgaggagaaggcgcu

SEQ ID NO: 1894 - RNA, 19 nt, Artificial Sequence
  Description of Artificial Sequence: Synthetic oligonucleotide
agcgccuucuccucggggc

SEQ ID NO: 1895 - RNA, 19 nt, Artificial Sequence
  Description of Artificial Sequence: Synthetic oligonucleotide
ggagaaggcgcugaggagg

SEQ ID NO: 1896 - RNA, 19 nt, Artificial Sequence
  Description of Artificial Sequence: Synthetic oligonucleotide
ccuccucagcgccuucucc

SEQ ID NO: 1897 - RNA, 19 nt, Artificial Sequence
  Description of Artificial Sequence: Synthetic oligonucleotide
aaggcgcugaggaggaaac

SEQ ID NO: 1898 - RNA, 19 nt, Artificial Sequence
  Description of Artificial Sequence: Synthetic oligonucleotide
guuuccuccucagcgccuu

SEQ ID NO: 1899 - RNA, 19 nt, Artificial Sequence
  Description of Artificial Sequence: Synthetic oligonucleotide
gcgcugaggaggaaacuga

SEQ ID NO: 1900 - RNA, 19 nt, Artificial Sequence
  Description of Artificial Sequence: Synthetic oligonucleotide
ucaguuuccuccucagcgc

SEQ ID NO: 1901 - RNA, 19 nt, Artificial Sequence
  Description of Artificial Sequence: Synthetic oligonucleotide
cgcugaggaggaaacugaa

SEQ ID NO: 1902 - RNA, 19 nt, Artificial Sequence
  Description of Artificial Sequence: Synthetic oligonucleotide
uucaguuuccuccucagcg

SEQ ID NO: 1903 - RNA, 19 nt, Artificial Sequence
  Description of Artificial Sequence: Synthetic oligonucleotide
gcugaggaggaaacugaaa

SEQ ID NO: 1904 - RNA, 19 nt, Artificial Sequence
  Description of Artificial Sequence: Synthetic oligonucleotide
uuucaguuuccuccucagc

SEQ ID NO: 1905 - RNA, 19 nt, Artificial Sequence
  Description of Artificial Sequence: Synthetic oligonucleotide
cugaggaggaaacugaaaa

SEQ ID NO: 1906 - RNA, 19 nt, Artificial Sequence
  Description of Artificial Sequence: Synthetic oligonucleotide
uuuucaguuuccuccucag

SEQ ID NO: 1907 - RNA, 19 nt, Artificial Sequence
  Description of Artificial Sequence: Synthetic oligonucleotide
gaggaggaaacugaaaaac

SEQ ID NO: 1908 - RNA, 19 nt, Artificial Sequence
  Description of Artificial Sequence: Synthetic oligonucleotide
guuuuucaguuuccuccuc

SEQ ID NO: 1909 - RNA, 19 nt, Artificial Sequence
  Description of Artificial Sequence: Synthetic oligonucleotide
ggaggaaacugaaaaacag

SEQ ID NO: 1910 - RNA, 19 nt, Artificial Sequence
  Description of Artificial Sequence: Synthetic oligonucleotide
cuguuuuucaguuuccucc

SEQ ID NO: 1911 - RNA, 19 nt, Artificial Sequence
  Description of Artificial Sequence: Synthetic oligonucleotide
gaggaaacugaaaaacaga

SEQ ID NO: 1912 - RNA, 19 nt, Artificial Sequence
  Description of Artificial Sequence: Synthetic oligonucleotide
ucuguuuuucaguuuccuc

SEQ ID NO: 1913 - RNA, 19 nt, Artificial Sequence
  Description of Artificial Sequence: Synthetic oligonucleotide
aaacugaaaaacagaguag

SEQ ID NO: 1914 - RNA, 19 nt, Artificial Sequence
  Description of Artificial Sequence: Synthetic oligonucleotide
cuacucuguuuuucaguuu

SEQ ID NO: 1915 - RNA, 19 nt, Artificial Sequence
  Description of Artificial Sequence: Synthetic oligonucleotide
cgaaugagugagcuggaac

SEQ ID NO: 1916 - RNA, 19 nt, Artificial Sequence
  Description of Artificial Sequence: Synthetic oligonucleotide
guuccagcucacucauucg

SEQ ID NO: 1917 - RNA, 19 nt, Artificial Sequence
  Description of Artificial Sequence: Synthetic oligonucleotide
gaaugagugagcuggaaca

SEQ ID NO: 1918 - RNA, 19 nt, Artificial Sequence
  Description of Artificial Sequence: Synthetic oligonucleotide
uguuccagcucacucauuc

SEQ ID NO: 1919 - RNA, 19 nt, Artificial Sequence
  Description of Artificial Sequence: Synthetic oligonucleotide
agugagcuggaacagcaag

SEQ ID NO: 1920 - RNA, 19 nt, Artificial Sequence
  Description of Artificial Sequence: Synthetic oligonucleotide
cuugcuguuccagcucacu

SEQ ID NO: 1921 - RNA, 19 nt, Artificial Sequence
  Description of Artificial Sequence: Synthetic oligonucleotide
ugagcuggaacagcaagug

SEQ ID NO: 1922 - RNA, 19 nt, Artificial Sequence
  Description of Artificial Sequence: Synthetic oligonucleotide
cacuugcuguuccagcuca

SEQ ID NO: 1923 - RNA, 19 nt, Artificial Sequence
  Description of Artificial Sequence: Synthetic oligonucleotide
gagcuggaacagcaagugg

SEQ ID NO: 1924 - RNA, 19 nt, Artificial Sequence
  Description of Artificial Sequence: Synthetic oligonucleotide
ccacuugcuguuccagcuc

SEQ ID NO: 1925 - RNA, 19 nt, Artificial Sequence
  Description of Artificial Sequence: Synthetic oligonucleotide
agcuggaacagcaaguggu

SEQ ID NO: 1926 - RNA, 19 nt, Artificial Sequence
  Description of Artificial Sequence: Synthetic oligonucleotide
accacuugcuguuccagcu

SEQ ID NO: 1927 - RNA, 19 nt, Artificial Sequence
  Description of Artificial Sequence: Synthetic oligonucleotide
uagauuuagaagaagagaa

SEQ ID NO: 1928 - RNA, 19 nt, Artificial Sequence
  Description of Artificial Sequence: Synthetic oligonucleotide
uucucuucuucuaaaucua

SEQ ID NO: 1929 - RNA, 19 nt, Artificial Sequence
  Description of Artificial Sequence: Synthetic oligonucleotide
agauuuagaagaagagaac

SEQ ID NO: 1930 - RNA, 19 nt, Artificial Sequence
  Description of Artificial Sequence: Synthetic oligonucleotide
guucucuucuucuaaaucu

SEQ ID NO: 1931 - RNA, 19 nt, Artificial Sequence
  Description of Artificial Sequence: Synthetic oligonucleotide
auuuagaagaagagaacca

SEQ ID NO: 1932 - RNA, 19 nt, Artificial Sequence
  Description of Artificial Sequence: Synthetic oligonucleotide
ugguucucuucuucuaaau

SEQ ID NO: 1933 - RNA, 19 nt, Artificial Sequence
  Description of Artificial Sequence: Synthetic oligonucleotide
uuuagaagaagagaaccaa

SEQ ID NO: 1934 - RNA, 19 nt, Artificial Sequence
  Description of Artificial Sequence: Synthetic oligonucleotide
uugguucucuucuucuaaa

SEQ ID NO: 1935 - RNA, 19 nt, Artificial Sequence
  Description of Artificial Sequence: Synthetic oligonucleotide
uagaagaagagaaccaaaa

SEQ ID NO: 1936 - RNA, 19 nt, Artificial Sequence
  Description of Artificial Sequence: Synthetic oligonucleotide
uuuugguucucuucuucua

SEQ ID NO: 1937 - RNA, 19 nt, Artificial Sequence
  Description of Artificial Sequence: Synthetic oligonucleotide
gaagagaaccaaaaacuuu

SEQ ID NO: 1938 - RNA, 19 nt, Artificial Sequence
  Description of Artificial Sequence: Synthetic oligonucleotide
aaaguuuuugguucucuuc

SEQ ID NO: 1939 - RNA, 19 nt, Artificial Sequence
  Description of Artificial Sequence: Synthetic oligonucleotide
cuuuugcuagaaaaucagc

SEQ ID NO: 1940 - RNA, 19 nt, Artificial Sequence
  Description of Artificial Sequence: Synthetic oligonucleotide
gcugauuuucuagcaaaag

SEQ ID NO: 1941 - RNA, 19 nt, Artificial Sequence
  Description of Artificial Sequence: Synthetic oligonucleotide
ugcuagaaaaucagcuuuu

SEQ ID NO: 1942 - RNA, 19 nt, Artificial Sequence
  Description of Artificial Sequence: Synthetic oligonucleotide
aaaagcugauuuucuagca

SEQ ID NO: 1943 - RNA, 19 nt, Artificial Sequence
  Description of Artificial Sequence: Synthetic oligonucleotide
uuuuacgagagaaaacuca

SEQ ID NO: 1944 - RNA, 19 nt, Artificial Sequence
  Description of Artificial Sequence: Synthetic oligonucleotide
ugaguuuucucucguaaaa

SEQ ID NO: 1945 - RNA, 19 nt, Artificial Sequence
  Description of Artificial Sequence: Synthetic oligonucleotide
uggggauggaugcccuggu

SEQ ID NO: 1946 - RNA, 19 nt, Artificial Sequence
  Description of Artificial Sequence: Synthetic oligonucleotide
accagggcauccaucccca

SEQ ID NO: 1947 - RNA, 19 nt, Artificial Sequence
  Description of Artificial Sequence: Synthetic oligonucleotide
gaggaggcggaagccaagg

SEQ ID NO: 1948 - DNA, 19 bp, Artificial Sequence
  Description of Combined DNA/RNA Molecule: Synthetic oligonucleotide
  Description of Artificial Sequence: Synthetic oligonucleotide
ccttggcttccgcctcctc

SEQ ID NO: 1949 - RNA, 19 nt, Artificial Sequence
  Description of Artificial Sequence: Synthetic oligonucleotide
ggcggaagccaaggggaau

SEQ ID NO: 1950 - RNA, 19 nt, Artificial Sequence
  Description of Artificial Sequence: Synthetic oligonucleotide
auuccccuuggcuuccgcc

SEQ ID NO: 1951 - RNA, 19 nt, Artificial Sequence
  Description of Artificial Sequence: Synthetic oligonucleotide
gugcaggcccaguugucac

SEQ ID NO: 1952 - RNA, 19 nt, Artificial Sequence
  Description of Artificial Sequence: Synthetic oligonucleotide
gugacaacugggccugcac

SEQ ID NO: 1953 - RNA, 19 nt, Artificial Sequence
  Description of Artificial Sequence: Synthetic oligonucleotide
ccuccagaacaucucccca

SEQ ID NO: 1954 - RNA, 19 nt, Artificial Sequence
  Description of Artificial Sequence: Synthetic oligonucleotide
uggggagauguucuggagg

SEQ ID NO: 1955 - RNA, 19 nt, Artificial Sequence
  Description of Artificial Sequence: Synthetic oligonucleotide
aucuccccauggauucugg

SEQ ID NO: 1956 - RNA, 19 nt, Artificial Sequence
  Description of Artificial Sequence: Synthetic oligonucleotide
ccagaauccauggggagau

SEQ ID NO: 1957 - RNA, 19 nt, Artificial Sequence
  Description of Artificial Sequence: Synthetic oligonucleotide
auugacucuucagauucag

SEQ ID NO: 1958 - RNA, 19 nt, Artificial Sequence
  Description of Artificial Sequence: Synthetic oligonucleotide
cugaaucugaagagucaau

SEQ ID NO: 1959 - RNA, 19 nt, Artificial Sequence
  Description of Artificial Sequence: Synthetic oligonucleotide
uucagauucagagucugau

SEQ ID NO: 1960 - RNA, 19 nt, Artificial Sequence
  Description of Artificial Sequence: Synthetic oligonucleotide
aucagacucugaaucugaa

SEQ ID NO: 1961 - RNA, 19 nt, Artificial Sequence
  Description of Artificial Sequence: Synthetic oligonucleotide
ucagauucagagucugaua

SEQ ID NO: 1962 - RNA, 19 nt, Artificial Sequence
  Description of Artificial Sequence: Synthetic oligonucleotide
uaucagacucugaaucuga

SEQ ID NO: 1963 - RNA, 19 nt, Artificial Sequence
  Description of Artificial Sequence: Synthetic oligonucleotide
auucuggacaacuuggacc

SEQ ID NO: 1964 - RNA, 19 nt, Artificial Sequence
  Description of Artificial Sequence: Synthetic oligonucleotide
gguccaaguuguccagaau

SEQ ID NO: 1965 - RNA, 19 nt, Artificial Sequence
  Description of Artificial Sequence: Synthetic oligonucleotide
uucuggacaacuuggaccc

SEQ ID NO: 1966 - RNA, 19 nt, Artificial Sequence
  Description of Artificial Sequence: Synthetic oligonucleotide
ggguccaaguuguccagaa

SEQ ID NO: 1967 - RNA, 19 nt, Artificial Sequence
  Description of Artificial Sequence: Synthetic oligonucleotide
cuggacaacuuggacccag

SEQ ID NO: 1968 - RNA, 19 nt, Artificial Sequence
  Description of Artificial Sequence: Synthetic oligonucleotide
cuggguccaaguuguccag

SEQ ID NO: 1969 - RNA, 19 nt, Artificial Sequence
  Description of Artificial Sequence: Synthetic oligonucleotide
gacccagucauguucuuca

SEQ ID NO: 1970 - RNA, 19 nt, Artificial Sequence
  Description of Artificial Sequence: Synthetic oligonucleotide
ugaagaacaugacuggguc

SEQ ID NO: 1971 - RNA, 19 nt, Artificial Sequence
  Description of Artificial Sequence: Synthetic oligonucleotide
auguucuucaaaugcccuu

SEQ ID NO: 1972 - RNA, 19 nt, Artificial Sequence
  Description of Artificial Sequence: Synthetic oligonucleotide
aagggcauuugaagaacau

SEQ ID NO: 1973 - RNA, 19 nt, Artificial Sequence
  Description of Artificial Sequence: Synthetic oligonucleotide
cugccagccuggaggagcu

SEQ ID NO: 1974 - RNA, 19 nt, Artificial Sequence
  Description of Artificial Sequence: Synthetic oligonucleotide
agcuccuccaggcuggcag

SEQ ID NO: 1975 - RNA, 19 nt, Artificial Sequence
  Description of Artificial Sequence: Synthetic oligonucleotide
cagccuggaggagcuccca

SEQ ID NO: 1976 - RNA, 19 nt, Artificial Sequence
  Description of Artificial Sequence: Synthetic oligonucleotide
ugggagcuccuccaggcug

SEQ ID NO: 1977 - RNA, 19 nt, Artificial Sequence
  Description of Artificial Sequence: Synthetic oligonucleotide
agccuggaggagcucccag

SEQ ID NO: 1978 - RNA, 19 nt, Artificial Sequence
  Description of Artificial Sequence: Synthetic oligonucleotide
cugggagcuccuccaggcu

SEQ ID NO: 1979 - RNA, 19 nt, Artificial Sequence
  Description of Artificial Sequence: Synthetic oligonucleotide
gccuggaggagcucccaga

SEQ ID NO: 1980 - RNA, 19 nt, Artificial Sequence
  Description of Artificial Sequence: Synthetic oligonucleotide
ucugggagcuccuccaggc

SEQ ID NO: 1981 - RNA, 19 nt, Artificial Sequence
  Description of Artificial Sequence: Synthetic oligonucleotide
ccuggaggagcucccagag

SEQ ID NO: 1982 - RNA, 19 nt, Artificial Sequence
  Description of Artificial Sequence: Synthetic oligonucleotide
cucugggagcuccuccagg

SEQ ID NO: 1983 - RNA, 19 nt, Artificial Sequence
  Description of Artificial Sequence: Synthetic oligonucleotide
uggaggagcucccagaggu

SEQ ID NO: 1984 - RNA, 19 nt, Artificial Sequence
  Description of Artificial Sequence: Synthetic oligonucleotide
accucugggagcuccucca

SEQ ID NO: 1985 - RNA, 19 nt, Artificial Sequence
  Description of Artificial Sequence: Synthetic oligonucleotide
ggaggagcucccagagguc

SEQ ID NO: 1986 - RNA, 19 nt, Artificial Sequence
  Description of Artificial Sequence: Synthetic oligonucleotide
gaccucugggagcuccucc

SEQ ID NO: 1987 - RNA, 19 nt, Artificial Sequence
  Description of Artificial Sequence: Synthetic oligonucleotide
cagaggucuacccagaagg

SEQ ID NO: 1988 - RNA, 19 nt, Artificial Sequence
  Description of Artificial Sequence: Synthetic oligonucleotide
ccuucuggguagaccucug

SEQ ID NO: 1989 - RNA, 19 nt, Artificial Sequence
  Description of Artificial Sequence: Synthetic oligonucleotide
uacccagaaggacccaguu

SEQ ID NO: 1990 - RNA, 19 nt, Artificial Sequence
  Description of Artificial Sequence: Synthetic oligonucleotide
aacuggguccuucugggua

SEQ ID NO: 1991 - RNA, 19 nt, Artificial Sequence
  Description of Artificial Sequence: Synthetic oligonucleotide
guuccuuaccagccucccu

SEQ ID NO: 1992 - RNA, 19 nt, Artificial Sequence
  Description of Artificial Sequence: Synthetic oligonucleotide
agggaggcugguaaggaac

SEQ ID NO: 1993 - RNA, 19 nt, Artificial Sequence
  Description of Artificial Sequence: Synthetic oligonucleotide
uuccuuaccagccucccuu

SEQ ID NO: 1994 - RNA, 19 nt, Artificial Sequence
  Description of Artificial Sequence: Synthetic oligonucleotide
aagggaggcugguaaggaa

SEQ ID NO: 1995 - RNA, 19 nt, Artificial Sequence
  Description of Artificial Sequence: Synthetic oligonucleotide
ccuuaccagccucccuuuc

SEQ ID NO: 1996 - RNA, 19 nt, Artificial Sequence
  Description of Artificial Sequence: Synthetic oligonucleotide
gaaagggaggcugguaagg

SEQ ID NO: 1997 - RNA, 19 nt, Artificial Sequence
  Description of Artificial Sequence: Synthetic oligonucleotide
accagccucccuuucucug

SEQ ID NO: 1998 - RNA, 19 nt, Artificial Sequence
  Description of Artificial Sequence: Synthetic oligonucleotide
cagagaaagggaggcuggu

SEQ ID NO: 1999 - RNA, 19 nt, Artificial Sequence
  Description of Artificial Sequence: Synthetic oligonucleotide
gccucccuuucucugucag

SEQ ID NO: 2000 - RNA, 19 nt, Artificial Sequence
  Description of Artificial Sequence: Synthetic oligonucleotide
cugacagagaaagggaggc

SEQ ID NO: 2001 - RNA, 19 nt, Artificial Sequence
  Description of Artificial Sequence: Synthetic oligonucleotide
cuuucucugucagugggga

SEQ ID NO: 2002 - RNA, 19 nt, Artificial Sequence
  Description of Artificial Sequence: Synthetic oligonucleotide
uccccacugacagagaaag

SEQ ID NO: 2003 - RNA, 19 nt, Artificial Sequence
  Description of Artificial Sequence: Synthetic oligonucleotide
uuucucugucaguggggac

SEQ ID NO: 2004 - RNA, 19 nt, Artificial Sequence
  Description of Artificial Sequence: Synthetic oligonucleotide
guccccacugacagagaaa

SEQ ID NO: 2005 - RNA, 19 nt, Artificial Sequence
  Description of Artificial Sequence: Synthetic oligonucleotide
cagccaagcuggaagccau

SEQ ID NO: 2006 - RNA, 19 nt, Artificial Sequence
  Description of Artificial Sequence: Synthetic oligonucleotide
auggcuuccagcuuggcug

SEQ ID NO: 2007 - RNA, 19 nt, Artificial Sequence
  Description of Artificial Sequence: Synthetic oligonucleotide
gagcuaugguggugguggc

SEQ ID NO: 2008 - RNA, 19 nt, Artificial Sequence
  Description of Artificial Sequence: Synthetic oligonucleotide
gccaccaccaccauagcuc

SEQ ID NO: 2009 - RNA, 19 nt, Artificial Sequence
  Description of Artificial Sequence: Synthetic oligonucleotide
agcuaugguggugguggca

SEQ ID NO: 2010 - RNA, 19 nt, Artificial Sequence
  Description of Artificial Sequence: Synthetic oligonucleotide
ugccaccaccaccauagcu

SEQ ID NO: 2011 - RNA, 19 nt, Artificial Sequence
  Description of Artificial Sequence: Synthetic oligonucleotide
ucuuagagauacccucuga

SEQ ID NO: 2012 - RNA, 19 nt, Artificial Sequence
  Description of Artificial Sequence: Synthetic oligonucleotide
ucagaggguaucucuaaga

SEQ ID NO: 2013 - RNA, 19 nt, Artificial Sequence
  Description of Artificial Sequence: Synthetic oligonucleotide
gauacccucugagacagag

SEQ ID NO: 2014 - RNA, 19 nt, Artificial Sequence
  Description of Artificial Sequence: Synthetic oligonucleotide
cucugucucagaggguauc

SEQ ID NO: 2015 - RNA, 19 nt, Artificial Sequence
  Description of Artificial Sequence: Synthetic oligonucleotide
cuaugguggugguggcagc

SEQ ID NO: 2016 - RNA, 19 nt, Artificial Sequence
  Description of Artificial Sequence: Synthetic oligonucleotide
gcugccaccaccaccauag

SEQ ID NO: 2017 - RNA, 19 nt, Artificial Sequence
  Description of Artificial Sequence: Synthetic oligonucleotide
cccucugagacagagagcc

SEQ ID NO: 2018 - RNA, 19 nt, Artificial Sequence
  Description of Artificial Sequence: Synthetic oligonucleotide
ggcucucugucucagaggg

SEQ ID NO: 2019 - RNA, 19 nt, Artificial Sequence
  Description of Artificial Sequence: Synthetic oligonucleotide
ccucugagacagagagcca

SEQ ID NO: 2020 - RNA, 19 nt, Artificial Sequence
  Description of Artificial Sequence: Synthetic oligonucleotide
uggcucucugucucagagg

SEQ ID NO: 2021 - RNA, 19 nt, Artificial Sequence
  Description of Artificial Sequence: Synthetic oligonucleotide
cucugagacagagagccaa

SEQ ID NO: 2022 - RNA, 19 nt, Artificial Sequence
  Description of Artificial Sequence: Synthetic oligonucleotide
uuggcucucugucucagag

SEQ ID NO: 2023 - RNA, 19 nt, Artificial Sequence
  Description of Artificial Sequence: Synthetic oligonucleotide
ucugagacagagagccaag

SEQ ID NO: 2024 - RNA, 19 nt, Artificial Sequence
  Description of Artificial Sequence: Synthetic oligonucleotide
cuuggcucucugucucaga

SEQ ID NO: 2025 - RNA, 19 nt, Artificial Sequence
  Description of Artificial Sequence: Synthetic oligonucleotide
cugagacagagagccaagc

SEQ ID NO: 2026 - RNA, 19 nt, Artificial Sequence
  Description of Artificial Sequence: Synthetic oligonucleotide
gcuuggcucucugucucag

SEQ ID NO: 2027 - RNA, 19 nt, Artificial Sequence
  Description of Artificial Sequence: Synthetic oligonucleotide
augguggugguggcagccg

SEQ ID NO: 2028 - RNA, 19 nt, Artificial Sequence
  Description of Artificial Sequence: Synthetic oligonucleotide
cggcugccaccaccaccau

SEQ ID NO: 2029 - RNA, 19 nt, Artificial Sequence
  Description of Artificial Sequence: Synthetic oligonucleotide
gaaaaucgaggaagcaccu

SEQ ID NO: 2030 - RNA, 19 nt, Artificial Sequence
  Description of Artificial Sequence: Synthetic oligonucleotide
aggugcuuccucgauuuuc

SEQ ID NO: 2031 - RNA, 19 nt, Artificial Sequence
  Description of Artificial Sequence: Synthetic oligonucleotide
aaaaucgaggaagcaccuc

SEQ ID NO: 2032 - RNA, 19 nt, Artificial Sequence
  Description of Artificial Sequence: Synthetic oligonucleotide
gaggugcuuccucgauuuu

SEQ ID NO: 2033 - RNA, 19 nt, Artificial Sequence
  Description of Artificial Sequence: Synthetic oligonucleotide
agcaccucucagccccuca

SEQ ID NO: 2034 - RNA, 19 nt, Artificial Sequence
  Description of Artificial Sequence: Synthetic oligonucleotide
ugaggggcugagaggugcu

SEQ ID NO: 2035 - RNA, 19 nt, Artificial Sequence
  Description of Artificial Sequence: Synthetic oligonucleotide
gagaaugaucacccugaau

SEQ ID NO: 2036 - RNA, 19 nt, Artificial Sequence
  Description of Artificial Sequence: Synthetic oligonucleotide
auucagggugaucauucuc

SEQ ID NO: 2037 - RNA, 19 nt, Artificial Sequence
  Description of Artificial Sequence: Synthetic oligonucleotide
cugaauucauugucucagu

SEQ ID NO: 2038 - RNA, 19 nt, Artificial Sequence
  Description of Artificial Sequence: Synthetic oligonucleotide
acugagacaaugaauucag

SEQ ID NO: 2039 - RNA, 19 nt, Artificial Sequence
  Description of Artificial Sequence: Synthetic oligonucleotide
ugaauucauugucucagug

SEQ ID NO: 2040 - RNA, 19 nt, Artificial Sequence
  Description of Artificial Sequence: Synthetic oligonucleotide
cacugagacaaugaauuca

SEQ ID NO: 2041 - RNA, 19 nt, Artificial Sequence
  Description of Artificial Sequence: Synthetic oligonucleotide
auucauugucucagugaag

SEQ ID NO: 2042 - RNA, 19 nt, Artificial Sequence
  Description of Artificial Sequence: Synthetic oligonucleotide
cuucacugagacaaugaau

SEQ ID NO: 2043 - RNA, 19 nt, Artificial Sequence
  Description of Artificial Sequence: Synthetic oligonucleotide
gugaaggaagaaccuguag

SEQ ID NO: 2044 - RNA, 19 nt, Artificial Sequence
  Description of Artificial Sequence: Synthetic oligonucleotide
cuacagguucuuccuucac

SEQ ID NO: 2045 - RNA, 19 nt, Artificial Sequence
  Description of Artificial Sequence: Synthetic oligonucleotide
agaaccuguagaagaugac

SEQ ID NO: 2046 - RNA, 19 nt, Artificial Sequence
  Description of Artificial Sequence: Synthetic oligonucleotide
gucaucuucuacagguucu

SEQ ID NO: 2047 - RNA, 19 nt, Artificial Sequence
  Description of Artificial Sequence: Synthetic oligonucleotide
ccgccggagccccggccgg

SEQ ID NO: 2048 - DNA, 19 bp, Artificial Sequence
  Description of Combined DNA/RNA Molecule: Synthetic oligonucleotide
  Description of Artificial Sequence: Synthetic oligonucleotide
ccggccggggctccggcgg

SEQ ID NO: 2049 - RNA, 19 nt, Artificial Sequence
  Description of Artificial Sequence: Synthetic oligonucleotide
gagccccgaggagaaggcg

SEQ ID NO: 2050 - DNA, 19 bp, Artificial Sequence
  Description of Combined DNA/RNA Molecule: Synthetic oligonucleotide
  Description of Artificial Sequence: Synthetic oligonucleotide
cgccttctcctcggggctc

SEQ ID NO: 2051 - RNA, 19 nt, Artificial Sequence
  Description of Artificial Sequence: Synthetic oligonucleotide
ucaaaugcccuuccccaga

SEQ ID NO: 2052 - RNA, 19 nt, Artificial Sequence
  Description of Artificial Sequence: Synthetic oligonucleotide
ucuggggaagggcauuuga

SEQ ID NO: 2053 - RNA, 19 nt, Artificial Sequence
  Description of Artificial Sequence: Synthetic oligonucleotide
gaggagcucccagaggucu

SEQ ID NO: 2054 - RNA, 19 nt, Artificial Sequence
  Description of Artificial Sequence: Synthetic oligonucleotide
agaccucugggagcuccuc

SEQ ID NO: 2055 - RNA, 19 nt, Artificial Sequence
  Description of Artificial Sequence: Synthetic oligonucleotide
cucccuuucucugucagug

SEQ ID NO: 2056 - RNA, 19 nt, Artificial Sequence
  Description of Artificial Sequence: Synthetic oligonucleotide
cacugacagagaaagggag

SEQ ID NO: 2057 - RNA, 19 nt, Artificial Sequence
  Description of Artificial Sequence: Synthetic oligonucleotide
aucagccaagcuggaagcc

SEQ ID NO: 2058 - RNA, 19 nt, Artificial Sequence
  Description of Artificial Sequence: Synthetic oligonucleotide
ggcuuccagcuuggcugau

SEQ ID NO: 2059 - RNA, 19 nt, Artificial Sequence
  Description of Artificial Sequence: Synthetic oligonucleotide
ccgaggagaaggcgcugag

SEQ ID NO: 2060 - RNA, 19 nt, Artificial Sequence
  Description of Artificial Sequence: Synthetic oligonucleotide
cucagcgccuucuccucgg

SEQ ID NO: 2061 - RNA, 19 nt, Artificial Sequence
  Description of Artificial Sequence: Synthetic oligonucleotide
uuuugcuagaaaaucagcu

SEQ ID NO: 2062 - RNA, 19 nt, Artificial Sequence
  Description of Artificial Sequence: Synthetic oligonucleotide
agcugauuuucuagcaaaa

SEQ ID NO: 2063 - RNA, 19 nt, Artificial Sequence
  Description of Artificial Sequence: Synthetic oligonucleotide
agcccgccuccgccgccgg

SEQ ID NO: 2064 - RNA, 19 nt, Artificial Sequence
  Description of Artificial Sequence: Synthetic oligonucleotide
ccggcggcggaggcgggcu

SEQ ID NO: 2065 - RNA, 19 nt, Artificial Sequence
  Description of Artificial Sequence: Synthetic oligonucleotide
cuccgccgccggagccccg

SEQ ID NO: 2066 - RNA, 19 nt, Artificial Sequence
  Description of Artificial Sequence: Synthetic oligonucleotide
cggggcuccggcggcggag

SEQ ID NO: 2067 - RNA, 19 nt, Artificial Sequence
  Description of Artificial Sequence: Synthetic oligonucleotide
ccgccgccggagccccggc

SEQ ID NO: 2068 - DNA, 19 bp, Artificial Sequence
  Description of Combined DNA/RNA Molecule: Synthetic oligonucleotide
  Description of Artificial Sequence: Synthetic oligonucleotide
gccggggctccggcggcgg

SEQ ID NO: 2069 - RNA, 19 nt, Artificial Sequence
  Description of Artificial Sequence: Synthetic oligonucleotide
agccccggccggccaggcc

SEQ ID NO: 2070 - DNA, 19 bp, Artificial Sequence
  Description of Combined DNA/RNA Molecule: Synthetic oligonucleotide
  Description of Artificial Sequence: Synthetic oligonucleotide
ggcctggccggccggggct

SEQ ID NO: 2071 - RNA, 19 nt, Artificial Sequence
  Description of Artificial Sequence: Synthetic oligonucleotide
cccgaggagaaggcgcuga

SEQ ID NO: 2072 - RNA, 19 nt, Artificial Sequence
  Description of Artificial Sequence: Synthetic oligonucleotide
ucagcgccuucuccucggg

SEQ ID NO: 2073 - RNA, 19 nt, Artificial Sequence
  Description of Artificial Sequence: Synthetic oligonucleotide
aggaaacugaaaaacagag

SEQ ID NO: 2074 - RNA, 19 nt, Artificial Sequence
  Description of Artificial Sequence: Synthetic oligonucleotide
cucuguuuuucaguuuccu

SEQ ID NO: 2075 - RNA, 19 nt, Artificial Sequence
  Description of Artificial Sequence: Synthetic oligonucleotide
uccuguugggcauucugga

SEQ ID NO: 2076 - RNA, 19 nt, Artificial Sequence
  Description of Artificial Sequence: Synthetic oligonucleotide
uccagaaugcccaacagga

SEQ ID NO: 2077 - RNA, 19 nt, Artificial Sequence
  Description of Artificial Sequence: Synthetic oligonucleotide
ccucccuuucucugucagu

SEQ ID NO: 2078 - RNA, 19 nt, Artificial Sequence
  Description of Artificial Sequence: Synthetic oligonucleotide
acugacagagaaagggagg

SEQ ID NO: 2079 - RNA, 19 nt, Artificial Sequence
  Description of Artificial Sequence: Synthetic oligonucleotide
gcuaugguggugguggcag

SEQ ID NO: 2080 - RNA, 19 nt, Artificial Sequence
  Description of Artificial Sequence: Synthetic oligonucleotide
cugccaccaccaccauagc

SEQ ID NO: 2081 - RNA, 19 nt, Artificial Sequence
  Description of Artificial Sequence: Synthetic oligonucleotide
guacuuuuaucuuaaaagg

SEQ ID NO: 2082 - RNA, 19 nt, Artificial Sequence
  Description of Artificial Sequence: Synthetic oligonucleotide
ccuuuuaagauaaaaguac

SEQ ID NO: 2083 - RNA, 19 nt, Artificial Sequence
  Description of Artificial Sequence: Synthetic oligonucleotide
uuaugaaugguucuuuauc

SEQ ID NO: 2084 - RNA, 19 nt, Artificial Sequence
  Description of Artificial Sequence: Synthetic oligonucleotide
gauaaagaaccauucauaa

SEQ ID NO: 2085 - RNA, 19 nt, Artificial Sequence
  Description of Artificial Sequence: Synthetic oligonucleotide
uuuaucauuucucuucccc

SEQ ID NO: 2086 - RNA, 19 nt, Artificial Sequence
  Description of Artificial Sequence: Synthetic oligonucleotide
ggggaagagaaaugauaaa

SEQ ID NO: 2087 - RNA, 19 nt, Artificial Sequence
  Description of Artificial Sequence: Synthetic oligonucleotide
gccuccgccgccggagccc

SEQ ID NO: 2088 - RNA, 19 nt, Artificial Sequence
  Description of Artificial Sequence: Synthetic oligonucleotide
gggcuccggcggcggaggc

SEQ ID NO: 2089 - RNA, 19 nt, Artificial Sequence
  Description of Artificial Sequence: Synthetic oligonucleotide
ccuccgccgccggagcccc

SEQ ID NO: 2090 - RNA, 19 nt, Artificial Sequence
  Description of Artificial Sequence: Synthetic oligonucleotide
ggggcuccggcggcggagg

SEQ ID NO: 2091 - RNA, 19 nt, Artificial Sequence
  Description of Artificial Sequence: Synthetic oligonucleotide
cugagccccgaggagaagg

SEQ ID NO: 2092 - RNA, 19 nt, Artificial Sequence
  Description of Artificial Sequence: Synthetic oligonucleotide
ccuucuccucggggcucag

SEQ ID NO: 2093 - RNA, 19 nt, Artificial Sequence
  Description of Artificial Sequence: Synthetic oligonucleotide
ggaaacugaaaaacagagu

SEQ ID NO: 2094 - RNA, 19 nt, Artificial Sequence
  Description of Artificial Sequence: Synthetic oligonucleotide
acucuguuuuucaguuucc

SEQ ID NO: 2095 - RNA, 19 nt, Artificial Sequence
  Description of Artificial Sequence: Synthetic oligonucleotide
gaaacugaaaaacagagua

SEQ ID NO: 2096 - RNA, 19 nt, Artificial Sequence
  Description of Artificial Sequence: Synthetic oligonucleotide
uacucuguuuuucaguuuc

SEQ ID NO: 2097 - RNA, 19 nt, Artificial Sequence
  Description of Artificial Sequence: Synthetic oligonucleotide
gauuuagaagaagagaacc

SEQ ID NO: 2098 - RNA, 19 nt, Artificial Sequence
  Description of Artificial Sequence: Synthetic oligonucleotide
gguucucuucuucuaaauc

SEQ ID NO: 2099 - RNA, 19 nt, Artificial Sequence
  Description of Artificial Sequence: Synthetic oligonucleotide
gcuagaaaaucagcuuuua

SEQ ID NO: 2100 - RNA, 19 nt, Artificial Sequence
  Description of Artificial Sequence: Synthetic oligonucleotide
uaaaagcugauuuucuagc

SEQ ID NO: 2101 - RNA, 19 nt, Artificial Sequence
  Description of Artificial Sequence: Synthetic oligonucleotide
uugacucuucagauucaga

SEQ ID NO: 2102 - RNA, 19 nt, Artificial Sequence
  Description of Artificial Sequence: Synthetic oligonucleotide
ucugaaucugaagagucaa

SEQ ID NO: 2103 - RNA, 19 nt, Artificial Sequence
  Description of Artificial Sequence: Synthetic oligonucleotide
ccuguugggcauucuggac

SEQ ID NO: 2104 - RNA, 19 nt, Artificial Sequence
  Description of Artificial Sequence: Synthetic oligonucleotide
guccagaaugcccaacagg

SEQ ID NO: 2105 - RNA, 19 nt, Artificial Sequence
  Description of Artificial Sequence: Synthetic oligonucleotide
ugccagccuggaggagcuc

SEQ ID NO: 2106 - RNA, 19 nt, Artificial Sequence
  Description of Artificial Sequence: Synthetic oligonucleotide
gagcuccuccaggcuggca

SEQ ID NO: 2107 - RNA, 19 nt, Artificial Sequence
  Description of Artificial Sequence: Synthetic oligonucleotide
gccagccuggaggagcucc

SEQ ID NO: 2108 - RNA, 19 nt, Artificial Sequence
  Description of Artificial Sequence: Synthetic oligonucleotide
ggagcuccuccaggcuggc

SEQ ID NO: 2109 - RNA, 19 nt, Artificial Sequence
  Description of Artificial Sequence: Synthetic oligonucleotide
ccagccuggaggagcuccc

SEQ ID NO: 2110 - RNA, 19 nt, Artificial Sequence
  Description of Artificial Sequence: Synthetic oligonucleotide
gggagcuccuccaggcugg

SEQ ID NO: 2111 - RNA, 19 nt, Artificial Sequence
  Description of Artificial Sequence: Synthetic oligonucleotide
uucucugucaguggggacg

SEQ ID NO: 2112 - RNA, 19 nt, Artificial Sequence
  Description of Artificial Sequence: Synthetic oligonucleotide
cguccccacugacagagaa

SEQ ID NO: 2113 - RNA, 19 nt, Artificial Sequence
  Description of Artificial Sequence: Synthetic oligonucleotide
gucuuagagauacccucug

SEQ ID NO: 2114 - RNA, 19 nt, Artificial Sequence
  Description of Artificial Sequence: Synthetic oligonucleotide
cagaggguaucucuaagac

SEQ ID NO: 2115 - RNA, 19 nt, Artificial Sequence
  Description of Artificial Sequence: Synthetic oligonucleotide
uaugguggugguggcagcc

SEQ ID NO: 2116 - RNA, 19 nt, Artificial Sequence
  Description of Artificial Sequence: Synthetic oligonucleotide
ggcugccaccaccaccaua

SEQ ID NO: 2117 - RNA, 19 nt, Artificial Sequence
  Description of Artificial Sequence: Synthetic oligonucleotide
uucauugucucagugaagg

SEQ ID NO: 2118 - RNA, 19 nt, Artificial Sequence
  Description of Artificial Sequence: Synthetic oligonucleotide
ccuucacugagacaaugaa

SEQ ID NO: 2119 - RNA, 19 nt, Artificial Sequence
  Description of Artificial Sequence: Synthetic oligonucleotide
agaaaacucacggccuugu

SEQ ID NO: 2120 - RNA, 19 nt, Artificial Sequence
  Description of Artificial Sequence: Synthetic oligonucleotide
acaaggccgugaguuuucu

SEQ ID NO: 2121 - RNA, 19 nt, Artificial Sequence
  Description of Artificial Sequence: Synthetic oligonucleotide
gagaaaacucacggccuug

SEQ ID NO: 2122 - RNA, 19 nt, Artificial Sequence
  Description of Artificial Sequence: Synthetic oligonucleotide
caaggccgugaguuuucuc

SEQ ID NO: 2123 - RNA, 19 nt, Artificial Sequence
  Description of Artificial Sequence: Synthetic oligonucleotide
cuuuugccaaugaacuuuu

SEQ ID NO: 2124 - RNA, 19 nt, Artificial Sequence
  Description of Artificial Sequence: Synthetic oligonucleotide
aaaaguucauuggcaaaag

SEQ ID NO: 2125 - RNA, 19 nt, Artificial Sequence
  Description of Artificial Sequence: Synthetic oligonucleotide
acuuuugccaaugaacuuu

SEQ ID NO: 2126 - RNA, 19 nt, Artificial Sequence
  Description of Artificial Sequence: Synthetic oligonucleotide
aaaguucauuggcaaaagu

SEQ ID NO: 2127 - RNA, 19 nt, Artificial Sequence
  Description of Artificial Sequence: Synthetic oligonucleotide
cccagcugauuagugucua

SEQ ID NO: 2128 - RNA, 19 nt, Artificial Sequence
  Description of Artificial Sequence: Synthetic oligonucleotide
uagacacuaaucagcuggg

SEQ ID NO: 2129 - RNA, 19 nt, Artificial Sequence
  Description of Artificial Sequence: Synthetic oligonucleotide
ccagcugauuagugucuaa

SEQ ID NO: 2130 - RNA, 19 nt, Artificial Sequence
  Description of Artificial Sequence: Synthetic oligonucleotide
uuagacacuaaucagcugg

SEQ ID NO: 2131 - RNA, 19 nt, Artificial Sequence
  Description of Artificial Sequence: Synthetic oligonucleotide
cucccagaggucuacccag

SEQ ID NO: 2132 - RNA, 19 nt, Artificial Sequence
  Description of Artificial Sequence: Synthetic oligonucleotide
cuggguagaccucugggag

SEQ ID NO: 2133 - RNA, 19 nt, Artificial Sequence
  Description of Artificial Sequence: Synthetic oligonucleotide
gaucacccugaauucauug

SEQ ID NO: 2134 - RNA, 19 nt, Artificial Sequence
  Description of Artificial Sequence: Synthetic oligonucleotide
caaugaauucagggugauc

SEQ ID NO: 2135 - RNA, 19 nt, Artificial Sequence
  Description of Artificial Sequence: Synthetic oligonucleotide
ucacccugaauucauuguc

SEQ ID NO: 2136 - RNA, 19 nt, Artificial Sequence
  Description of Artificial Sequence: Synthetic oligonucleotide
gacaaugaauucaggguga

SEQ ID NO: 2137 - RNA, 19 nt, Artificial Sequence
  Description of Artificial Sequence: Synthetic oligonucleotide
ccccagcugauuagugucu

SEQ ID NO: 2138 - RNA, 19 nt, Artificial Sequence
  Description of Artificial Sequence: Synthetic oligonucleotide
agacacuaaucagcugggg

SEQ ID NO: 2139 - RNA, 19 nt, Artificial Sequence
  Description of Artificial Sequence: Synthetic oligonucleotide
aucacccugaauucauugu

SEQ ID NO: 2140 - RNA, 19 nt, Artificial Sequence
  Description of Artificial Sequence: Synthetic oligonucleotide
acaaugaauucagggugau

SEQ ID NO: 2141 - RNA, 19 nt, Artificial Sequence
  Description of Artificial Sequence: Synthetic oligonucleotide
cauuuauuuaaaacuaccc

SEQ ID NO: 2142 - RNA, 19 nt, Artificial Sequence
  Description of Artificial Sequence: Synthetic oligonucleotide
ggguaguuuuaaauaaaug

SEQ ID NO: 2143 - RNA, 19 nt, Artificial Sequence
  Description of Artificial Sequence: Synthetic oligonucleotide
acugaaaaacagaguagca

SEQ ID NO: 2144 - RNA, 19 nt, Artificial Sequence
  Description of Artificial Sequence: Synthetic oligonucleotide
ugcuacucuguuuuucagu

SEQ ID NO: 2145 - RNA, 19 nt, Artificial Sequence
  Description of Artificial Sequence: Synthetic oligonucleotide
ccauuuauuuaaaacuacc

SEQ ID NO: 2146 - RNA, 19 nt, Artificial Sequence
  Description of Artificial Sequence: Synthetic oligonucleotide
gguaguuuuaaauaaaugg

SEQ ID NO: 2147 - RNA, 19 nt, Artificial Sequence
  Description of Artificial Sequence: Synthetic oligonucleotide
uugagaaccaggaguuaag

SEQ ID NO: 2148 - RNA, 19 nt, Artificial Sequence
  Description of Artificial Sequence: Synthetic oligonucleotide
cuuaacuccugguucucaa

SEQ ID NO: 2149 - RNA, 19 nt, Artificial Sequence
  Description of Artificial Sequence: Synthetic oligonucleotide
cacccugaauucauugucu

SEQ ID NO: 2150 - RNA, 19 nt, Artificial Sequence
  Description of Artificial Sequence: Synthetic oligonucleotide
agacaaugaauucagggug

SEQ ID NO: 2151 - RNA, 19 nt, Artificial Sequence
  Description of Artificial Sequence: Synthetic oligonucleotide
aacugaaaaacagaguagc

SEQ ID NO: 2152 - RNA, 19 nt, Artificial Sequence
  Description of Artificial Sequence: Synthetic oligonucleotide
gcuacucuguuuuucaguu

SEQ ID NO: 2153 - RNA, 19 nt, Artificial Sequence
  Description of Artificial Sequence: Synthetic oligonucleotide
cugaaaaacagaguagcag

SEQ ID NO: 2154 - RNA, 19 nt, Artificial Sequence
  Description of Artificial Sequence: Synthetic oligonucleotide
cugcuacucuguuuuucag

SEQ ID NO: 2155 - DNA, 21 bp, Artificial Sequence
  Description of Combined DNA/RNA Molecule: Synthetic oligonucleotide
  Description of Artificial Sequence: Synthetic oligonucleotide
cccagcugauuagugucuatt

SEQ ID NO: 2156 - DNA, 21 bp, Artificial Sequence
  Description of Combined DNA/RNA Molecule: Synthetic oligonucleotide
  Description of Artificial Sequence: Synthetic oligonucleotide
uagacacuaaucagcugggtt

SEQ ID NO: 2157 - DNA, 21 bp, Artificial Sequence
  Description of Combined DNA/RNA Molecule: Synthetic oligonucleotide
  Description of Artificial Sequence: Synthetic oligonucleotide
ccagcugauuagugucuaatt

SEQ ID NO: 2158 - DNA, 21 bp, Artificial Sequence
  Description of Combined DNA/RNA Molecule: Synthetic oligonucleotide
  Description of Artificial Sequence: Synthetic oligonucleotide
uuagacacuaaucagcuggtt

SEQ ID NO: 2159 - DNA, 21 bp, Artificial Sequence
  Description of Combined DNA/RNA Molecule: Synthetic oligonucleotide
  Description of Artificial Sequence: Synthetic oligonucleotide
cucccagaggucuacccagtt

SEQ ID NO: 2160 - DNA, 21 bp, Artificial Sequence
  Description of Combined DNA/RNA Molecule: Synthetic oligonucleotide
  Description of Artificial Sequence: Synthetic oligonucleotide
cuggguagaccucugggagtt

SEQ ID NO: 2161 - DNA, 21 bp, Artificial Sequence
  Description of Combined DNA/RNA Molecule: Synthetic oligonucleotide
  Description of Artificial Sequence: Synthetic oligonucleotide
gaucacccugaauucauugtt

SEQ ID NO: 2162 - DNA, 21 bp, Artificial Sequence
  Description of Combined DNA/RNA Molecule: Synthetic oligonucleotide
  Description of Artificial Sequence: Synthetic oligonucleotide
caaugaauucagggugauctt

SEQ ID NO: 2163 - DNA, 21 bp, Artificial Sequence
  Description of Combined DNA/RNA Molecule: Synthetic oligonucleotide
  Description of Artificial Sequence: Synthetic oligonucleotide
ucacccugaauucauuguctt

SEQ ID NO: 2164 - DNA, 21 bp, Artificial Sequence
  Description of Combined DNA/RNA Molecule: Synthetic oligonucleotide
  Description of Artificial Sequence: Synthetic oligonucleotide
gacaaugaauucagggugatt

SEQ ID NO: 2165 - DNA, 21 bp, Artificial Sequence
  Description of Combined DNA/RNA Molecule: Synthetic oligonucleotide
  Description of Artificial Sequence: Synthetic oligonucleotide
ccccagcugauuagugucutt

SEQ ID NO: 2166 - DNA, 21 bp, Artificial Sequence
  Description of Combined DNA/RNA Molecule: Synthetic oligonucleotide
  Description of Artificial Sequence: Synthetic oligonucleotide
agacacuaaucagcuggggtt

SEQ ID NO: 2167 - DNA, 21 bp, Artificial Sequence
  Description of Combined DNA/RNA Molecule: Synthetic oligonucleotide
  Description of Artificial Sequence: Synthetic oligonucleotide
aucacccugaauucauugutt

SEQ ID NO: 2168 - DNA, 21 bp, Artificial Sequence
  Description of Combined DNA/RNA Molecule: Synthetic oligonucleotide
  Description of Artificial Sequence: Synthetic oligonucleotide
acaaugaauucagggugautt

SEQ ID NO: 2169 - DNA, 21 bp, Artificial Sequence
  Description of Combined DNA/RNA Molecule: Synthetic oligonucleotide
  Description of Artificial Sequence: Synthetic oligonucleotide
cauuuauuuaaaacuaccctt

SEQ ID NO: 2170 - DNA, 21 bp, Artificial Sequence
  Description of Combined DNA/RNA Molecule: Synthetic oligonucleotide
  Description of Artificial Sequence: Synthetic oligonucleotide
ggguaguuuuaaauaaaugtt

SEQ ID NO: 2171 - DNA, 21 bp, Artificial Sequence
  Description of Combined DNA/RNA Molecule: Synthetic oligonucleotide
  Description of Artificial Sequence: Synthetic oligonucleotide
acugaaaaacagaguagcatt

SEQ ID NO: 2172 - DNA, 21 bp, Artificial Sequence
  Description of Combined DNA/RNA Molecule: Synthetic oligonucleotide
  Description of Artificial Sequence: Synthetic oligonucleotide
ugcuacucuguuuuucagutt

SEQ ID NO: 2173 - DNA, 21 bp, Artificial Sequence
  Description of Combined DNA/RNA Molecule: Synthetic oligonucleotide
  Description of Artificial Sequence: Synthetic oligonucleotide
ccauuuauuuaaaacuacctt

SEQ ID NO: 2174 - DNA, 21 bp, Artificial Sequence
  Description of Combined DNA/RNA Molecule: Synthetic oligonucleotide
  Description of Artificial Sequence: Synthetic oligonucleotide
gguaguuuuaaauaaauggtt

SEQ ID NO: 2175 - DNA, 21 bp, Artificial Sequence
  Description of Combined DNA/RNA Molecule: Synthetic oligonucleotide
  Description of Artificial Sequence: Synthetic oligonucleotide
uugagaaccaggaguuaagtt

SEQ ID NO: 2176 - DNA, 21 bp, Artificial Sequence
  Description of Combined DNA/RNA Molecule: Synthetic oligonucleotide
  Description of Artificial Sequence: Synthetic oligonucleotide
cuuaacuccugguucucaatt

SEQ ID NO: 2177 - DNA, 21 bp, Artificial Sequence
  Description of Combined DNA/RNA Molecule: Synthetic oligonucleotide
  Description of Artificial Sequence: Synthetic oligonucleotide
cacccugaauucauugucutt

SEQ ID NO: 2178 - DNA, 21 bp, Artificial Sequence
  Description of Combined DNA/RNA Molecule: Synthetic oligonucleotide
  Description of Artificial Sequence: Synthetic oligonucleotide
agacaaugaauucagggugtt

SEQ ID NO: 2179 - DNA, 21 bp, Artificial Sequence
  Description of Combined DNA/RNA Molecule: Synthetic oligonucleotide
  Description of Artificial Sequence: Synthetic oligonucleotide
aacugaaaaacagaguagctt

SEQ ID NO: 2180 - DNA, 21 bp, Artificial Sequence
  Description of Combined DNA/RNA Molecule: Synthetic oligonucleotide
  Description of Artificial Sequence: Synthetic oligonucleotide
gcuacucuguuuuucaguutt

SEQ ID NO: 2181 - DNA, 21 bp, Artificial Sequence
  Description of Combined DNA/RNA Molecule: Synthetic oligonucleotide
  Description of Artificial Sequence: Synthetic oligonucleotide
cugaaaaacagaguagcagtt

SEQ ID NO: 2182 - DNA, 21 bp, Artificial Sequence
  Description of Combined DNA/RNA Molecule: Synthetic oligonucleotide
  Description of Artificial Sequence: Synthetic oligonucleotide
cugcuacucuguuuuucagtt

SEQ ID NO: 2183 - DNA, 21 bp, Artificial Sequence
  Description of Combined DNA/RNA Molecule: Synthetic oligonucleotide
  Description of Artificial Sequence: Synthetic oligonucleotide
agaaaaucagcuuuuacgatt

SEQ ID NO: 2184 - DNA, 21 bp, Artificial Sequence
  Description of Combined DNA/RNA Molecule: Synthetic oligonucleotide
  Description of Artificial Sequence: Synthetic oligonucleotide
ucguaaaagcugauuuucutt

SEQ ID NO: 2185 - DNA, 21 bp, Artificial Sequence
  Description of Combined DNA/RNA Molecule: Synthetic oligonucleotide
  Description of Artificial Sequence: Synthetic oligonucleotide
uccccagcugauuaguguctt

SEQ ID NO: 2186 - DNA, 21 bp, Artificial Sequence
  Description of Combined DNA/RNA Molecule: Synthetic oligonucleotide
  Description of Artificial Sequence: Synthetic oligonucleotide
gacacuaaucagcuggggatt

SEQ ID NO: 2187 - DNA, 21 bp, Artificial Sequence
  Description of Combined DNA/RNA Molecule: Synthetic oligonucleotide
  Description of Artificial Sequence: Synthetic oligonucleotide
uacuuauuauguaaggguctt

SEQ ID NO: 2188 - DNA, 21 bp, Artificial Sequence
  Description of Combined DNA/RNA Molecule: Synthetic oligonucleotide
  Description of Artificial Sequence: Synthetic oligonucleotide
gacccuuacauaauaaguatt

SEQ ID NO: 2189 - DNA, 21 bp, Artificial Sequence
  Description of Combined DNA/RNA Molecule: Synthetic oligonucleotide
  Description of Artificial Sequence: Synthetic oligonucleotide
uaucuuaaaagggugguagtt

SEQ ID NO: 2190 - DNA, 21 bp, Artificial Sequence
  Description of Combined DNA/RNA Molecule: Synthetic oligonucleotide
  Description of Artificial Sequence: Synthetic oligonucleotide
cuaccacccuuuuaagauatt

SEQ ID NO: 2191 - DNA, 21 bp, Artificial Sequence
  Description of Combined DNA/RNA Molecule: Synthetic oligonucleotide
  Description of Artificial Sequence: Synthetic oligonucleotide
ccauggauucuggcgguautt

SEQ ID NO: 2192 - DNA, 21 bp, Artificial Sequence
  Description of Combined DNA/RNA Molecule: Synthetic oligonucleotide
  Description of Artificial Sequence: Synthetic oligonucleotide
auaccgccagaauccauggtt

SEQ ID NO: 2193 - DNA, 21 bp, Artificial Sequence
  Description of Combined DNA/RNA Molecule: Synthetic oligonucleotide
  Description of Artificial Sequence: Synthetic oligonucleotide
uuaaugaacuaauucguuutt

SEQ ID NO: 2194 - DNA, 21 bp, Artificial Sequence
  Description of Combined DNA/RNA Molecule: Synthetic oligonucleotide
  Description of Artificial Sequence: Synthetic oligonucleotide
aaacgaauuaguucauuaatt

SEQ ID NO: 2195 - DNA, 21 bp, Artificial Sequence
  Description of Combined DNA/RNA Molecule: Synthetic oligonucleotide
  Description of Artificial Sequence: Synthetic oligonucleotide
agggucauuagacaaaugutt

SEQ ID NO: 2196 - DNA, 21 bp, Artificial Sequence
  Description of Combined DNA/RNA Molecule: Synthetic oligonucleotide
  Description of Artificial Sequence: Synthetic oligonucleotide
acauuugucuaaugacccutt

SEQ ID NO: 2197 - DNA, 21 bp, Artificial Sequence
  Description of Combined DNA/RNA Molecule: Synthetic oligonucleotide
  Description of Artificial Sequence: Synthetic oligonucleotide
ugaacuaauucguuuugactt

SEQ ID NO: 2198 - DNA, 21 bp, Artificial Sequence
  Description of Combined DNA/RNA Molecule: Synthetic oligonucleotide
  Description of Artificial Sequence: Synthetic oligonucleotide
gucaaaacgaauuaguucatt

SEQ ID NO: 2199 - DNA, 21 bp, Artificial Sequence
  Description of Combined DNA/RNA Molecule: Synthetic oligonucleotide
  Description of Artificial Sequence: Synthetic oligonucleotide
uuccccagcugauuagugutt

SEQ ID NO: 2200 - DNA, 21 bp, Artificial Sequence
  Description of Combined DNA/RNA Molecule: Synthetic oligonucleotide
  Description of Artificial Sequence: Synthetic oligonucleotide
acacuaaucagcuggggaatt

SEQ ID NO: 2201 - DNA, 21 bp, Artificial Sequence
  Description of Combined DNA/RNA Molecule: Synthetic oligonucleotide
  Description of Artificial Sequence: Synthetic oligonucleotide
uauguaagggucauuagactt

SEQ ID NO: 2202 - DNA, 21 bp, Artificial Sequence
  Description of Combined DNA/RNA Molecule: Synthetic oligonucleotide
  Description of Artificial Sequence: Synthetic oligonucleotide
gucuaaugacccuuacauatt

SEQ ID NO: 2203 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaaaucagcuuuuacgann

SEQ ID NO: 2204 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucguaaaagcugauuuucunn

SEQ ID NO: 2205 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccccagcugauuagugucnn

SEQ ID NO: 2206 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacacuaaucagcuggggann

SEQ ID NO: 2207 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuuauuauguaagggucnn

SEQ ID NO: 2208 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacccuuacauaauaaguann

SEQ ID NO: 2209 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaucuuaaaagggugguagnn

SEQ ID NO: 2210 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaccacccuuuuaagauann

SEQ ID NO: 2211 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccauggauucuggcgguaunn

SEQ ID NO: 2212 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auaccgccagaauccauggnn

SEQ ID NO: 2213 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaaugaacuaauucguuunn

SEQ ID NO: 2214 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacgaauuaguucauuaann

SEQ ID NO: 2215 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggucauuagacaaaugunn

SEQ ID NO: 2216 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acauuugucuaaugacccunn

SEQ ID NO: 2217 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaacuaauucguuuugacnn

SEQ ID NO: 2218 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaaaacgaauuaguucann

SEQ ID NO: 2219 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaagggucauuagacaann

SEQ ID NO: 2220 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugucuaaugacccuuacann

SEQ ID NO: 2221 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuaauucguuuugaccann

SEQ ID NO: 2222 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggucaaaacgaauuaguunn

SEQ ID NO: 2223 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuuaaaacuacccaugcnn

SEQ ID NO: 2224 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauggguaguuuuaaauann

SEQ ID NO: 2225 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccccagcugauuagugunn

SEQ ID NO: 2226 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acacuaaucagcuggggaann

SEQ ID NO: 2227 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauguaagggucauuagacnn

SEQ ID NO: 2228 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucuaaugacccuuacauann

SEQ ID NO: 2229 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaagggucauuagacaaann

SEQ ID NO: 2230 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugucuaaugacccuuacnn

SEQ ID NO: 2231 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcucccagaggucuacccann

SEQ ID NO: 2232 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggguagaccucugggagcnn

SEQ ID NO: 2233 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagccaagcuaaugugguann

SEQ ID NO: 2234 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccacauuagcuuggcucnn

SEQ ID NO: 2235 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccuacuggaugcuuacnn

SEQ ID NO: 2236 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaagcauccaguaggcagnn

SEQ ID NO: 2237 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuacuggaugcuuacagnn

SEQ ID NO: 2238 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguaagcauccaguaggcnn

SEQ ID NO: 2239 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuugguguaaaccauucunn

SEQ ID NO: 2240 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaugguuuacaccaagcnn

SEQ ID NO: 2241 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugguguaaaccauucuunn

SEQ ID NO: 2242 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaaugguuuacaccaagnn

SEQ ID NO: 2243 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuccccagcugauuagugnn

SEQ ID NO: 2244 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacuaaucagcuggggaaann

SEQ ID NO: 2245 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccagcugauuagugucuann

SEQ ID NO: 2246 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagacacuaaucagcugggnn

SEQ ID NO: 2247 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcugauuagugucuaaggnn

SEQ ID NO: 2248 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuagacacuaaucagcunn

SEQ ID NO: 2249 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcccuuuuccuugacuaunn

SEQ ID NO: 2250 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auagucaaggaaaagggcann

SEQ ID NO: 2251 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuccuugacuauuacacnn

SEQ ID NO: 2252 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guguaauagucaaggaaaann

SEQ ID NO: 2253 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugacuauuacacugccugnn

SEQ ID NO: 2254 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggcaguguaauagucaann

SEQ ID NO: 2255 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacuauuacacugccuggnn

SEQ ID NO: 2256 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaggcaguguaauagucann

SEQ ID NO: 2257 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuacagcuuuuaagauugnn

SEQ ID NO: 2258 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaucuuaaaagcuguagunn

SEQ ID NO: 2259 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagcuuuuaagauuguacnn

SEQ ID NO: 2260 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guacaaucuuaaaagcugunn

SEQ ID NO: 2261 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcuuuuaagauuguacunn

SEQ ID NO: 2262 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguacaaucuuaaaagcugnn

SEQ ID NO: 2263 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auacuuauuauguaagggunn

SEQ ID NO: 2264 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccuuacauaauaaguaunn

SEQ ID NO: 2265 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auguaagggucauuagacann

SEQ ID NO: 2266 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucuaaugacccuuacaunn

SEQ ID NO: 2267 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagggucauuagacaaaugnn

SEQ ID NO: 2268 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuugucuaaugacccuunn

SEQ ID NO: 2269 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugccuccaguuuuaggucnn

SEQ ID NO: 2270 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaccuaaaacuggaggcaann

SEQ ID NO: 2271 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuacccaugcaauuaaann

SEQ ID NO: 2272 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaauugcauggguaguunn

SEQ ID NO: 2273 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugccagagaucgaaagann

SEQ ID NO: 2274 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuucgaucucuggcagunn

SEQ ID NO: 2275 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccagagaucgaaagaann

SEQ ID NO: 2276 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuuucgaucucuggcagnn

SEQ ID NO: 2277 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucagcuuuuacgagagaann

SEQ ID NO: 2278 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucucguaaaagcugaunn

SEQ ID NO: 2279 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccauggauucuggcgguann

SEQ ID NO: 2280 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccgccagaauccaugggnn

SEQ ID NO: 2281 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauggauucuggcgguauunn

SEQ ID NO: 2282 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauaccgccagaauccaugnn

SEQ ID NO: 2283 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuggcgguauugacucunn

SEQ ID NO: 2284 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagucaauaccgccagaann

SEQ ID NO: 2285 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcgguauugacucuucagnn

SEQ ID NO: 2286 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaagagucaauaccgccnn

SEQ ID NO: 2287 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucagagucugauauccugnn

SEQ ID NO: 2288 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggauaucagacucugaann

SEQ ID NO: 2289 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugauauccuguugggcann

SEQ ID NO: 2290 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcccaacaggauaucagann

SEQ ID NO: 2291 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauauccuguugggcauucnn

SEQ ID NO: 2292 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaugcccaacaggauaucnn

SEQ ID NO: 2293 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucccagaggucuacccagnn

SEQ ID NO: 2294 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggguagaccucugggagnn

SEQ ID NO: 2295 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaggacccaguuccuuacnn

SEQ ID NO: 2296 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaaggaacuggguccuucnn

SEQ ID NO: 2297 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggacgucaucagccaagnn

SEQ ID NO: 2298 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuggcugaugacguccccnn

SEQ ID NO: 2299 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augaacuaauucguuuugann

SEQ ID NO: 2300 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaaacgaauuaguucaunn

SEQ ID NO: 2301 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucguuuugaccacauauaunn

SEQ ID NO: 2302 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auauauguggucaaaacgann

SEQ ID NO: 2303 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugaccacauauauaccann

SEQ ID NO: 2304 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguauauauguggucaaann

SEQ ID NO: 2305 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugaccacauauauaccaann

SEQ ID NO: 2306 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugguauauauguggucaann

SEQ ID NO: 2307 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acauauauaccaagccccunn

SEQ ID NO: 2308 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggggcuugguauauaugunn

SEQ ID NO: 2309 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccaagcuaaugugguagnn

SEQ ID NO: 2310 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaccacauuagcuuggcunn

SEQ ID NO: 2311 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaagcuaaugugguagunn

SEQ ID NO: 2312 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuaccacauuagcuuggcnn

SEQ ID NO: 2313 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaagcuaaugugguagugnn

SEQ ID NO: 2314 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacuaccacauuagcuuggnn

SEQ ID NO: 2315 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuaaugugguagugaaann

SEQ ID NO: 2316 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucacuaccacauuagcunn

SEQ ID NO: 2317 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguagugaaaaucgaggaann

SEQ ID NO: 2318 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccucgauuuucacuaccnn

SEQ ID NO: 2319 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucgaggaagcaccucucnn

SEQ ID NO: 2320 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaggugcuuccucgauunn

SEQ ID NO: 2321 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccccucagagaaugaucann

SEQ ID NO: 2322 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaucauucucugaggggcnn

SEQ ID NO: 2323 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaucacccugaauucauunn

SEQ ID NO: 2324 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugaauucagggugaucann

SEQ ID NO: 2325 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccagcugauuagugucunn

SEQ ID NO: 2326 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacacuaaucagcuggggnn

SEQ ID NO: 2327 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagcugauuagugucuaann

SEQ ID NO: 2328 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagacacuaaucagcuggnn

SEQ ID NO: 2329 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugggaggacacuuuugcnn

SEQ ID NO: 2330 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaaaaguguccucccaagnn

SEQ ID NO: 2331 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaacuacccaugcaauunn

SEQ ID NO: 2332 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauugcauggguaguuuuann

SEQ ID NO: 2333 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccccauggauucuggcgnn

SEQ ID NO: 2334 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccagaauccauggggagnn

SEQ ID NO: 2335 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaucucaaaucugcuuucann

SEQ ID NO: 2336 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaagcagauuugagauann

SEQ ID NO: 2337 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaugcuuacagugacugnn

SEQ ID NO: 2338 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagucacuguaagcauccann

SEQ ID NO: 2339 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuccuugacuauuacann

SEQ ID NO: 2340 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaauagucaaggaaaagnn

SEQ ID NO: 2341 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaucuuaaaaggguggunn

SEQ ID NO: 2342 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accacccuuuuaagauaaann

SEQ ID NO: 2343 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuuauuauguaagggucann

SEQ ID NO: 2344 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacccuuacauaauaagunn

SEQ ID NO: 2345 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuauuauguaagggucaunn

SEQ ID NO: 2346 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augacccuuacauaauaagnn

SEQ ID NO: 2347 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuauguaagggucauuagann

SEQ ID NO: 2348 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuaaugacccuuacauaann

SEQ ID NO: 2349 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugcugagggggcucuuunn

SEQ ID NO: 2350 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagagcccccucagcaggnn

SEQ ID NO: 2351 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auagaaauuuacuauguaann

SEQ ID NO: 2352 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuacauaguaaauuucuaunn

SEQ ID NO: 2353 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacugccagagaucgaaann

SEQ ID NO: 2354 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucgaucucuggcagucunn

SEQ ID NO: 2355 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccccauggauucuggcggnn

SEQ ID NO: 2356 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgccagaauccauggggann

SEQ ID NO: 2357 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaugaacuaauucguuuunn

SEQ ID NO: 2358 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaacgaauuaguucauuann

SEQ ID NO: 2359 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucacccugaauucauugucnn

SEQ ID NO: 2360 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacaaugaauucagggugann

SEQ ID NO: 2361 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcuggguaucucaaaucnn

SEQ ID NO: 2362 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuugagauacccagcucnn

SEQ ID NO: 2363 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuccuugacuauuacacunn

SEQ ID NO: 2364 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguguaauagucaaggaaann

SEQ ID NO: 2365 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccuugacuauuacacugnn

SEQ ID NO: 2366 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguguaauagucaaggaann

SEQ ID NO: 2367 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagccaaaauagagaguann

SEQ ID NO: 2368 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacucucuauuuuggcuuunn

SEQ ID NO: 2369 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuguucagaucucauagnn

SEQ ID NO: 2370 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaugagaucugaacaaaunn

SEQ ID NO: 2371 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuaucuuaaaaggguggnn

SEQ ID NO: 2372 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacccuuuuaagauaaaann

SEQ ID NO: 2373 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guauacuucaaguaagaucnn

SEQ ID NO: 2374 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucuuacuugaaguauacnn

SEQ ID NO: 2375 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauacuucaaguaagaucann

SEQ ID NO: 2376 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaucuuacuugaaguauann

SEQ ID NO: 2377 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaauuuuuuccugcuagnn

SEQ ID NO: 2378 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuagcaggaaaaaauuccann

SEQ ID NO: 2379 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccugcuaguguagcuucnn

SEQ ID NO: 2380 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagcuacacuagcaggaann

SEQ ID NO: 2381 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaugcaauuaaaagguacnn

SEQ ID NO: 2382 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaccuuuuaauugcauggnn

SEQ ID NO: 2383 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacagcaagugguagauunn

SEQ ID NO: 2384 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucuaccacuugcuguucnn

SEQ ID NO: 2385 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accaaaaacuuuugcuagann

SEQ ID NO: 2386 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuagcaaaaguuuuuggunn

SEQ ID NO: 2387 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaaaaacuuuugcuagaann

SEQ ID NO: 2388 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuagcaaaaguuuuuggnn

SEQ ID NO: 2389 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccauggauucuggcggunn

SEQ ID NO: 2390 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accgccagaauccauggggnn

SEQ ID NO: 2391 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auauccuguugggcauucunn

SEQ ID NO: 2392 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaugcccaacaggauaunn

SEQ ID NO: 2393 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucauguucuucaaaugcnn

SEQ ID NO: 2394 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauuugaagaacaugacunn

SEQ ID NO: 2395 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guagugaaaaucgaggaagnn

SEQ ID NO: 2396 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuccucgauuuucacuacnn

SEQ ID NO: 2397 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucacccugaauucauugnn

SEQ ID NO: 2398 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaugaauucagggugaucnn

SEQ ID NO: 2399 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucacccugaauucauugunn

SEQ ID NO: 2400 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaaugaauucagggugaunn

SEQ ID NO: 2401 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugaacuaauucguuuugnn

SEQ ID NO: 2402 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaacgaauuaguucauunn

SEQ ID NO: 2403 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuagugucuaaggaaugann

SEQ ID NO: 2404 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauuccuuagacacuaaunn

SEQ ID NO: 2405 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaauucguuuugaccacann

SEQ ID NO: 2406 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguggucaaaacgaauuagnn

SEQ ID NO: 2407 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucguuuugaccacauauann

SEQ ID NO: 2408 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauauguggucaaaacgaann

SEQ ID NO: 2409 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuagagauacccucugagnn

SEQ ID NO: 2410 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagaggguaucucuaagnn

SEQ ID NO: 2411 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugccuggaggauagcagnn

SEQ ID NO: 2412 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuauccuccaggcagunn

SEQ ID NO: 2413 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuguacuuuuaucuuaaann

SEQ ID NO: 2414 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaagauaaaaguacaaunn

SEQ ID NO: 2415 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuagacaaaugucuugann

SEQ ID NO: 2416 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaagacauuugucuaaugnn

SEQ ID NO: 2417 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaugaaugguucuuuaucann

SEQ ID NO: 2418 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugauaaagaaccauucauann

SEQ ID NO: 2419 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacuacccaugcaauuaann

SEQ ID NO: 2420 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaauugcauggguaguuunn

SEQ ID NO: 2421 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcucgaaugagugagcuggnn

SEQ ID NO: 2422 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagcucacucauucgagcnn

SEQ ID NO: 2423 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaucagcuuuuacgagagnn

SEQ ID NO: 2424 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucucguaaaagcugauuunn

SEQ ID NO: 2425 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaguggggacgucaucann

SEQ ID NO: 2426 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaugacguccccacugacnn

SEQ ID NO: 2427 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuaaugaacuaauucgunn

SEQ ID NO: 2428 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acgaauuaguucauuaaugnn

SEQ ID NO: 2429 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagacaaaugucuugaagnn

SEQ ID NO: 2430 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucaagacauuugucuaann

SEQ ID NO: 2431 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caugcaauuaaaagguacann

SEQ ID NO: 2432 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaccuuuuaauugcaugnn

SEQ ID NO: 2433 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauucguuuugaccacauann

SEQ ID NO: 2434 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauguggucaaaacgaauunn

SEQ ID NO: 2435 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggucauuagacaaaugucunn

SEQ ID NO: 2436 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacauuugucuaaugaccnn

SEQ ID NO: 2437 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuaaaagguacaaugcann

SEQ ID NO: 2438 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcauuguaccuuuuaauunn

SEQ ID NO: 2439 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaaaucagcuuuuacgagnn

SEQ ID NO: 2440 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucguaaaagcugauuuucnn

SEQ ID NO: 2441 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaccacauauauaccaagcnn

SEQ ID NO: 2442 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuugguauauauguggucnn

SEQ ID NO: 2443 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggucauuagacaaaugucnn

SEQ ID NO: 2444 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacauuugucuaaugacccnn

SEQ ID NO: 2445 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguagcuucugaaaggugcnn

SEQ ID NO: 2446 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaccuuucagaagcuacann

SEQ ID NO: 2447 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guugagaaccaggaguuaann

SEQ ID NO: 2448 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaacuccugguucucaacnn

SEQ ID NO: 2449 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accaggaguuaagacagcgnn

SEQ ID NO: 2450 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgcugucuuaacuccuggunn

SEQ ID NO: 2451 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuaaaagggugguaguunn

SEQ ID NO: 2452 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuaccacccuuuuaagann

SEQ ID NO: 2453 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuccugcuaguguagcunn

SEQ ID NO: 2454 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuacacuagcaggaaaann

SEQ ID NO: 2455 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaggaguuaagacagcgcnn

SEQ ID NO: 2456 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgcugucuuaacuccuggnn

SEQ ID NO: 2457 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuccugccuacuggaugcnn

SEQ ID NO: 2458 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauccaguaggcaggaagnn

SEQ ID NO: 2459 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuacuggaugcuuacagunn

SEQ ID NO: 2460 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuguaagcauccaguaggnn

SEQ ID NO: 2461 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugucuaaggaaugauccnn

SEQ ID NO: 2462 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaucauuccuuagacacunn

SEQ ID NO: 2463 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugucuaaggaaugauccann

SEQ ID NO: 2464 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaucauuccuuagacacnn

SEQ ID NO: 2465 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuauaauugagaacuacnn

SEQ ID NO: 2466 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaguucucaauuauaguann

SEQ ID NO: 2467 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuuaaaagggugguagunn

SEQ ID NO: 2468 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuaccacccuuuuaagaunn

SEQ ID NO: 2469 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucuggcgguauugacucnn

SEQ ID NO: 2470 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagucaauaccgccagaaunn

SEQ ID NO: 2471 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacccaguuccuuaccagcnn

SEQ ID NO: 2472 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugguaaggaacugggucnn

SEQ ID NO: 2473 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugucaguggggacgucann

SEQ ID NO: 2474 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacguccccacugacagann

SEQ ID NO: 2475 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccauuaaugaacuaauucnn

SEQ ID NO: 2476 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauuaguucauuaauggcnn

SEQ ID NO: 2477 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaccacauauauaccaagnn

SEQ ID NO: 2478 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugguauauauguggucann

SEQ ID NO: 2479 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacauauauaccaagcccnn

SEQ ID NO: 2480 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcuugguauauauguggnn

SEQ ID NO: 2481 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuggguaucucaaaucugnn

SEQ ID NO: 2482 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagauuugagauacccagcnn

SEQ ID NO: 2483 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auugagaacuacagcuuuunn

SEQ ID NO: 2484 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaagcuguaguucucaaunn

SEQ ID NO: 2485 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuucaaguaagaucaagnn

SEQ ID NO: 2486 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugaucuuacuugaaguann

SEQ ID NO: 2487 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaacagaguagcagcucnn

SEQ ID NO: 2488 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcugcuacucuguuuuunn

SEQ ID NO: 2489 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuuugaccacauauauacnn

SEQ ID NO: 2490 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guauauauguggucaaaacnn

SEQ ID NO: 2491 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugaaaaacagaguagcann

SEQ ID NO: 2492 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuacucuguuuuucagunn

SEQ ID NO: 2493 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucagauucagagucugnn

SEQ ID NO: 2494 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagacucugaaucugaagann

SEQ ID NO: 2495 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaucugcuuucauccagnn

SEQ ID NO: 2496 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaugaaagcagauuugnn

SEQ ID NO: 2497 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accauucuugggaggacacnn

SEQ ID NO: 2498 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guguccucccaagaauggunn

SEQ ID NO: 2499 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugggaggacacuuuugccnn

SEQ ID NO: 2500 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcaaaaguguccucccaann

SEQ ID NO: 2501 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcugauuagugucuaagnn

SEQ ID NO: 2502 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuagacacuaaucagcugnn

SEQ ID NO: 2503 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugauuagugucuaaggaaunn

SEQ ID NO: 2504 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuccuuagacacuaaucann

SEQ ID NO: 2505 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagugucuaaggaaugaunn

SEQ ID NO: 2506 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucauuccuuagacacuaann

SEQ ID NO: 2507 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuauuacacugccuggagnn

SEQ ID NO: 2508 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccaggcaguguaauagunn

SEQ ID NO: 2509 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaugguucuuuaucauunn

SEQ ID NO: 2510 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugauaaagaaccauucann

SEQ ID NO: 2511 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaugguucuuuaucauuunn

SEQ ID NO: 2512 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaugauaaagaaccauucnn

SEQ ID NO: 2513 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaguaagaucaagaaucnn

SEQ ID NO: 2514 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauucuugaucuuacuugann

SEQ ID NO: 2515 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauagaaauuuacuauguann

SEQ ID NO: 2516 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacauaguaaauuucuauann

SEQ ID NO: 2517 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuuacuauguaaaugcunn

SEQ ID NO: 2518 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcauuuacauaguaaauunn

SEQ ID NO: 2519 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaaaacuacccaugcaaunn

SEQ ID NO: 2520 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auugcauggguaguuuuaann

SEQ ID NO: 2521 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugccccaggcgcgcaagnn

SEQ ID NO: 2522 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugcgcgccuggggcagcnn

SEQ ID NO: 2523 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacugaaaaacagaguagcnn

SEQ ID NO: 2524 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuacucuguuuuucaguunn

SEQ ID NO: 2525 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaacagaguagcagcucann

SEQ ID NO: 2526 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagcugcuacucuguuuunn

SEQ ID NO: 2527 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaguagcagcucagacugcnn

SEQ ID NO: 2528 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagucugagcugcuacucnn

SEQ ID NO: 2529 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaacagcaagugguagaunn

SEQ ID NO: 2530 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuaccacuugcuguuccnn

SEQ ID NO: 2531 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugagaaccaggaguuaagnn

SEQ ID NO: 2532 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuaacuccugguucucaann

SEQ ID NO: 2533 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaggcccaguugucacccnn

SEQ ID NO: 2534 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggugacaacugggccugcnn

SEQ ID NO: 2535 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaucuccccauggauucunn

SEQ ID NO: 2536 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaauccauggggagaugunn

SEQ ID NO: 2537 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggcgguauugacucuunn

SEQ ID NO: 2538 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagagucaauaccgccagann

SEQ ID NO: 2539 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggacccagucauguucunn

SEQ ID NO: 2540 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaacaugacuggguccaann

SEQ ID NO: 2541 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacgucaucagccaagcunn

SEQ ID NO: 2542 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuuggcugaugacguccnn

SEQ ID NO: 2543 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucagagaaugaucacccnn

SEQ ID NO: 2544 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggugaucauucucugaggnn

SEQ ID NO: 2545 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacccugaauucauugucunn

SEQ ID NO: 2546 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacaaugaauucagggugnn

SEQ ID NO: 2547 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaggaagaaccuguagaann

SEQ ID NO: 2548 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuacagguucuuccuucnn

SEQ ID NO: 2549 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaucucaaaucugcuuucnn

SEQ ID NO: 2550 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaagcagauuugagauacnn

SEQ ID NO: 2551 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucugcuuucauccagccnn

SEQ ID NO: 2552 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuggaugaaagcagauunn

SEQ ID NO: 2553 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugguguaaaccauucuugnn

SEQ ID NO: 2554 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagaaugguuuacaccaann

SEQ ID NO: 2555 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guguaaaccauucuugggann

SEQ ID NO: 2556 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucccaagaaugguuuacacnn

SEQ ID NO: 2557 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaaaccauucuugggagnn

SEQ ID NO: 2558 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucccaagaaugguuuacann

SEQ ID NO: 2559 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugggaggacacuuuugccann

SEQ ID NO: 2560 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcaaaaguguccucccann

SEQ ID NO: 2561 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggacacuuuugccaaugnn

SEQ ID NO: 2562 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuggcaaaaguguccucnn

SEQ ID NO: 2563 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuagugucuaaggaaugnn

SEQ ID NO: 2564 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuccuuagacacuaaucnn

SEQ ID NO: 2565 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagugucuaaggaaugaucnn

SEQ ID NO: 2566 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucauuccuuagacacuann

SEQ ID NO: 2567 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuguugcccuuuuccuugnn

SEQ ID NO: 2568 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaggaaaagggcaacagunn

SEQ ID NO: 2569 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucggggcagcccgccucnn

SEQ ID NO: 2570 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggcgggcugccccgacann

SEQ ID NO: 2571 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucggggcagcccgccuccnn

SEQ ID NO: 2572 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggcgggcugccccgacnn

SEQ ID NO: 2573 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagggucauuagacaaaunn

SEQ ID NO: 2574 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuugucuaaugacccuuann

SEQ ID NO: 2575 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucuucccccuuuuuggcnn

SEQ ID NO: 2576 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaaaaagggggaagagann

SEQ ID NO: 2577 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auacuucaaguaagaucaann

SEQ ID NO: 2578 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugaucuuacuugaaguaunn

SEQ ID NO: 2579 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaguaagaucaagaaucunn

SEQ ID NO: 2580 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauucuugaucuuacuugnn

SEQ ID NO: 2581 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccauuuauuuaaaacuaccnn

SEQ ID NO: 2582 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguaguuuuaaauaaauggnn

SEQ ID NO: 2583 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuuauuuaaaacuacccnn

SEQ ID NO: 2584 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggguaguuuuaaauaaaugnn

SEQ ID NO: 2585 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaaaaacagaguagcagnn

SEQ ID NO: 2586 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuacucuguuuuucagnn

SEQ ID NO: 2587 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaaaacagaguagcagcunn

SEQ ID NO: 2588 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcugcuacucuguuuuucnn

SEQ ID NO: 2589 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaguagcagcucagacunn

SEQ ID NO: 2590 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucugagcugcuacucugnn

SEQ ID NO: 2591 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguagcagcucagacugccnn

SEQ ID NO: 2592 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcagucugagcugcuacunn

SEQ ID NO: 2593 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaagugguagauuuagann

SEQ ID NO: 2594 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuaaaucuaccacuugcunn

SEQ ID NO: 2595 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcuuuuacgagagaaaann

SEQ ID NO: 2596 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuucucucguaaaagcugnn

SEQ ID NO: 2597 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuuuuacgagagaaaacnn

SEQ ID NO: 2598 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuuucucucguaaaagcunn

SEQ ID NO: 2599 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuuuacgagagaaaacunn

SEQ ID NO: 2600 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuuucucucguaaaagcnn

SEQ ID NO: 2601 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaggccaguggccgggucnn

SEQ ID NO: 2602 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacccggccacuggccucann

SEQ ID NO: 2603 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaguggccgggucugcugnn

SEQ ID NO: 2604 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcagacccggccacuggnn

SEQ ID NO: 2605 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccagaacaucuccccaugnn

SEQ ID NO: 2606 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauggggagauguucuggann

SEQ ID NO: 2607 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaacaucuccccauggann

SEQ ID NO: 2608 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccauggggagauguucugnn

SEQ ID NO: 2609 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacaucuccccauggauucnn

SEQ ID NO: 2610 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauccauggggagauguunn

SEQ ID NO: 2611 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuccccauggauucuggcnn

SEQ ID NO: 2612 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccagaauccauggggagann

SEQ ID NO: 2613 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugggcauucuggacaacuunn

SEQ ID NO: 2614 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaguuguccagaaugcccann

SEQ ID NO: 2615 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauguucuucaaaugcccnn

SEQ ID NO: 2616 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcauuugaagaacaugann

SEQ ID NO: 2617 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguucuucaaaugcccuucnn

SEQ ID NO: 2618 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagggcauuugaagaacann

SEQ ID NO: 2619 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacuaauucguuuugaccnn

SEQ ID NO: 2620 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggucaaaacgaauuaguucnn

SEQ ID NO: 2621 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuaauucguuuugaccacnn

SEQ ID NO: 2622 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guggucaaaacgaauuagunn

SEQ ID NO: 2623 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucguuuugaccacauaunn

SEQ ID NO: 2624 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auauguggucaaaacgaaunn

SEQ ID NO: 2625 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacauauauaccaagccccnn

SEQ ID NO: 2626 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcuugguauauaugugnn

SEQ ID NO: 2627 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagagauacccucugagann

SEQ ID NO: 2628 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucagaggguaucucuaann

SEQ ID NO: 2629 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagagccaagcuaauguggnn

SEQ ID NO: 2630 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacauuagcuuggcucucnn

SEQ ID NO: 2631 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuaaugugguagugaaaann

SEQ ID NO: 2632 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuucacuaccacauuagcnn

SEQ ID NO: 2633 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugaaaaucgaggaagcann

SEQ ID NO: 2634 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuuccucgauuuucacunn

SEQ ID NO: 2635 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugaaaaucgaggaagcacnn

SEQ ID NO: 2636 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugcuuccucgauuuucacnn

SEQ ID NO: 2637 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaagaaccuguagaagann

SEQ ID NO: 2638 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucuacagguucuuccunn

SEQ ID NO: 2639 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucuuuugacauccagcagnn

SEQ ID NO: 2640 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuggaugucaaaagacnn

SEQ ID NO: 2641 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcccugccgcucauggugnn

SEQ ID NO: 2642 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caccaugagcggcagggccnn

SEQ ID NO: 2643 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuacagcuuuuaagauunn

SEQ ID NO: 2644 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucuuaaaagcuguaguunn

SEQ ID NO: 2645 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaggaggcggaagccaann

SEQ ID NO: 2646 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ttggcttccgcctcctcttnn

SEQ ID NO: 2647 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccaguugucaccccuccnn

SEQ ID NO: 2648 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggggugacaacugggcnn

SEQ ID NO: 2649 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggauucuggcgguauugann

SEQ ID NO: 2650 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaauaccgccagaauccann

SEQ ID NO: 2651 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccuacuggaugcuuacann

SEQ ID NO: 2652 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaagcauccaguaggcann

SEQ ID NO: 2653 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggauucuggcgguauugacnn

SEQ ID NO: 2654 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaauaccgccagaauccnn

SEQ ID NO: 2655 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucagagucugauauccunn

SEQ ID NO: 2656 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggauaucagacucugaaunn

SEQ ID NO: 2657 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggguaucucaaaucugcnn

SEQ ID NO: 2658 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagauuugagauacccagnn

SEQ ID NO: 2659 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggguaucucaaaucugcunn

SEQ ID NO: 2660 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcagauuugagauacccann

SEQ ID NO: 2661 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaccauucuugggaggacann

SEQ ID NO: 2662 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguccucccaagaaugguunn

SEQ ID NO: 2663 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuugacuauuacacugcnn

SEQ ID NO: 2664 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaguguaauagucaaggann

SEQ ID NO: 2665 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugacuauuacacugccunn

SEQ ID NO: 2666 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcaguguaauagucaagnn

SEQ ID NO: 2667 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacuauuacacugccuggann

SEQ ID NO: 2668 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccaggcaguguaauagucnn

SEQ ID NO: 2669 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuuuuaagauuguacuunn

SEQ ID NO: 2670 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaguacaaucuuaaaagcunn

SEQ ID NO: 2671 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaucuuaaaagggugguann

SEQ ID NO: 2672 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccacccuuuuaagauaann

SEQ ID NO: 2673 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucauuagacaaaugucuunn

SEQ ID NO: 2674 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagacauuugucuaaugacnn

SEQ ID NO: 2675 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuugccuccaguuuuagnn

SEQ ID NO: 2676 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaaaacuggaggcaagccnn

SEQ ID NO: 2677 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaguuugcuucuguaagcnn

SEQ ID NO: 2678 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuacagaagcaaacuaann

SEQ ID NO: 2679 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuacuauguaaaugcuugann

SEQ ID NO: 2680 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaagcauuuacauaguaann

SEQ ID NO: 2681 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuauguaaaugcuugaugnn

SEQ ID NO: 2682 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucaagcauuuacauagunn

SEQ ID NO: 2683 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaugcuugauggaauuuunn

SEQ ID NO: 2684 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaauuccaucaagcauuunn

SEQ ID NO: 2685 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuaguguagcuucugaann

SEQ ID NO: 2686 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucagaagcuacacuagcann

SEQ ID NO: 2687 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuauuuaaaacuacccann

SEQ ID NO: 2688 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggguaguuuuaaauaaaunn

SEQ ID NO: 2689 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccaugcaauuaaaaggunn

SEQ ID NO: 2690 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accuuuuaauugcaugggunn

SEQ ID NO: 2691 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccgcucauggugccagccnn

SEQ ID NO: 2692 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuggcaccaugagcggcnn

SEQ ID NO: 2693 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagacugccagagaucgnn

SEQ ID NO: 2694 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgaucucuggcagucugagnn

SEQ ID NO: 2695 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacagcaagugguagauuunn

SEQ ID NO: 2696 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaucuaccacuugcuguunn

SEQ ID NO: 2697 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaccaaaaacuuuugcunn

SEQ ID NO: 2698 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaaaaguuuuugguucunn

SEQ ID NO: 2699 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaccaaaaacuuuugcuagnn

SEQ ID NO: 2700 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuagcaaaaguuuuugguunn

SEQ ID NO: 2701 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgggucugcugaguccgcnn

SEQ ID NO: 2702 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggacucagcagacccggnn

SEQ ID NO: 2703 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgggucugcugaguccgcann

SEQ ID NO: 2704 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcggacucagcagacccgnn

SEQ ID NO: 2705 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggauucuggcgguauugnn

SEQ ID NO: 2706 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caauaccgccagaauccaunn

SEQ ID NO: 2707 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauucuggcgguauugacunn

SEQ ID NO: 2708 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucaauaccgccagaaucnn

SEQ ID NO: 2709 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagucugauauccuguuggnn

SEQ ID NO: 2710 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaacaggauaucagacucnn

SEQ ID NO: 2711 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guggggacgucaucagccann

SEQ ID NO: 2712 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcugaugacguccccacnn

SEQ ID NO: 2713 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugugguagugaaaaucgagnn

SEQ ID NO: 2714 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucgauuuucacuaccacann

SEQ ID NO: 2715 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaggaagaaccuguagann

SEQ ID NO: 2716 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuacagguucuuccuucann

SEQ ID NO: 2717 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acacugccuggaggauagcnn

SEQ ID NO: 2718 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuauccuccaggcagugunn

SEQ ID NO: 2719 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuacccaugcaauuaaaann

SEQ ID NO: 2720 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuaauugcauggguagunn

SEQ ID NO: 2721 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggacccaguuccuuaccann

SEQ ID NO: 2722 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguaaggaacuggguccunn

SEQ ID NO: 2723 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgucaucagccaagcuggann

SEQ ID NO: 2724 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccagcuuggcugaugacgnn

SEQ ID NO: 2725 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaauucguuuugaccacaunn

SEQ ID NO: 2726 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auguggucaaaacgaauuann

SEQ ID NO: 2727 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuugaccacauauauaccnn

SEQ ID NO: 2728 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguauauauguggucaaaann

SEQ ID NO: 2729 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuucugucggggcagcnn

SEQ ID NO: 2730 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugccccgacagaagcagnn

SEQ ID NO: 2731 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaaaacagaguagcagcnn

SEQ ID NO: 2732 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugcuacucuguuuuucann

SEQ ID NO: 2733 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuaaugaacuaauucguunn

SEQ ID NO: 2734 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacgaauuaguucauuaaunn

SEQ ID NO: 2735 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuugggaggacacuuuugnn

SEQ ID NO: 2736 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaaguguccucccaagann

SEQ ID NO: 2737 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugauuagugucuaaggaann

SEQ ID NO: 2738 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccuuagacacuaaucagnn

SEQ ID NO: 2739 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccuuuuccuugacuauunn

SEQ ID NO: 2740 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauagucaaggaaaagggcnn

SEQ ID NO: 2741 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuuuccuugacuauuacnn

SEQ ID NO: 2742 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaauagucaaggaaaaggnn

SEQ ID NO: 2743 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuauuacacugccuggaggnn

SEQ ID NO: 2744 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuccaggcaguguaauagnn

SEQ ID NO: 2745 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauugagaacuacagcuuunn

SEQ ID NO: 2746 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagcuguaguucucaauunn

SEQ ID NO: 2747 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuauguaagggucauuagnn

SEQ ID NO: 2748 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaaugacccuuacauaaunn

SEQ ID NO: 2749 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguucuuuaucauuucucunn

SEQ ID NO: 2750 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagaaaugauaaagaaccnn

SEQ ID NO: 2751 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauccuggcuugccuccagnn

SEQ ID NO: 2752 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaggcaagccaggaugnn

SEQ ID NO: 2753 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuugccuccaguuuuaggnn

SEQ ID NO: 2754 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuaaaacuggaggcaagcnn

SEQ ID NO: 2755 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuccugcuaguguagcuunn

SEQ ID NO: 2756 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcuacacuagcaggaaann

SEQ ID NO: 2757 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccgcucauggugccagnn

SEQ ID NO: 2758 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggcaccaugagcggcagnn

SEQ ID NO: 2759 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggcagcgagcggggggcnn

SEQ ID NO: 2760 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccccccgctcgctgcctcnn

SEQ ID NO: 2761 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgagcggggggcugccccnn

SEQ ID NO: 2762 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcagccccccgcucgcnn

SEQ ID NO: 2763 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guagcagcucagacugccann

SEQ ID NO: 2764 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcagucugagcugcuacnn

SEQ ID NO: 2765 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaacagcaagugguagann

SEQ ID NO: 2766 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuaccacuugcuguuccann

SEQ ID NO: 2767 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaacuuuugcuagaaaann

SEQ ID NO: 2768 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuucuagcaaaaguuuuunn

SEQ ID NO: 2769 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguggccgggucugcugagnn

SEQ ID NO: 2770 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagcagacccggccacunn

SEQ ID NO: 2771 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccgggucugcugaguccnn

SEQ ID NO: 2772 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacucagcagacccggccnn

SEQ ID NO: 2773 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggcccaguugucaccccnn

SEQ ID NO: 2774 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggugacaacugggccugnn

SEQ ID NO: 2775 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaacaucuccccauggaunn

SEQ ID NO: 2776 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccauggggagauguucunn

SEQ ID NO: 2777 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaggacccaguuccuuaccnn

SEQ ID NO: 2778 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguaaggaacuggguccuunn

SEQ ID NO: 2779 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagagagccaagcuaaugnn

SEQ ID NO: 2780 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuagcuuggcucucugunn

SEQ ID NO: 2781 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccucagagaaugaucaccnn

SEQ ID NO: 2782 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggugaucauucucugagggnn

SEQ ID NO: 2783 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauugucucagugaaggann

SEQ ID NO: 2784 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuucacugagacaaugann

SEQ ID NO: 2785 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuggguaucucaaaucunn

SEQ ID NO: 2786 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauuugagauacccagcunn

SEQ ID NO: 2787 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggguaucucaaaucugcuunn

SEQ ID NO: 2788 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcagauuugagauacccnn

SEQ ID NO: 2789 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucucaaaucugcuuucaunn

SEQ ID NO: 2790 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augaaagcagauuugagaunn

SEQ ID NO: 2791 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaucugcuuucauccagcnn

SEQ ID NO: 2792 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuggaugaaagcagauuunn

SEQ ID NO: 2793 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucugcuuucauccagccann

SEQ ID NO: 2794 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcuggaugaaagcagaunn

SEQ ID NO: 2795 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugcuuucauccagccacnn

SEQ ID NO: 2796 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guggcuggaugaaagcagann

SEQ ID NO: 2797 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuuucauccagccacugnn

SEQ ID NO: 2798 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguggcuggaugaaagcann

SEQ ID NO: 2799 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuucauccagccacugcnn

SEQ ID NO: 2800 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaguggcuggaugaaagcnn

SEQ ID NO: 2801 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuucauccagccacugccnn

SEQ ID NO: 2802 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcaguggcuggaugaaagnn

SEQ ID NO: 2803 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucauccagccacugcccnn

SEQ ID NO: 2804 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcaguggcuggaugaaann

SEQ ID NO: 2805 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaucuuccugccuacuggnn

SEQ ID NO: 2806 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaguaggcaggaagauggnn

SEQ ID NO: 2807 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucuuccugccuacuggann

SEQ ID NO: 2808 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccaguaggcaggaagaugnn

SEQ ID NO: 2809 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuuccugccuacuggaunn

SEQ ID NO: 2810 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccaguaggcaggaagaunn

SEQ ID NO: 2811 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuccugccuacuggaugnn

SEQ ID NO: 2812 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauccaguaggcaggaagann

SEQ ID NO: 2813 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccugccuacuggaugcunn

SEQ ID NO: 2814 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcauccaguaggcaggaann

SEQ ID NO: 2815 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugccuacuggaugcuuann

SEQ ID NO: 2816 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagcauccaguaggcaggnn

SEQ ID NO: 2817 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuggaugcuuacagugann

SEQ ID NO: 2818 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucacuguaagcauccaguann

SEQ ID NO: 2819 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaugcuuacagugacunn

SEQ ID NO: 2820 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucacuguaagcauccagnn

SEQ ID NO: 2821 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaugcuuacagugacugunn

SEQ ID NO: 2822 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagucacuguaagcauccnn

SEQ ID NO: 2823 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augcuuacagugacuguggnn

SEQ ID NO: 2824 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacagucacuguaagcaunn

SEQ ID NO: 2825 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuuacagugacuguggann

SEQ ID NO: 2826 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccacagucacuguaagcann

SEQ ID NO: 2827 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuacagugacuguggauann

SEQ ID NO: 2828 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauccacagucacuguaagnn

SEQ ID NO: 2829 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguguaaaccauucuuggnn

SEQ ID NO: 2830 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaagaaugguuuacaccann

SEQ ID NO: 2831 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguguaaaccauucuugggnn

SEQ ID NO: 2832 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccaagaaugguuuacaccnn

SEQ ID NO: 2833 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaaaccauucuugggaggnn

SEQ ID NO: 2834 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucccaagaaugguuuacnn

SEQ ID NO: 2835 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaccauucuugggaggann

SEQ ID NO: 2836 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccucccaagaaugguuuann

SEQ ID NO: 2837 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaccauucuugggaggacnn

SEQ ID NO: 2838 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guccucccaagaaugguuunn

SEQ ID NO: 2839 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccauucuugggaggacacunn

SEQ ID NO: 2840 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguguccucccaagaauggnn

SEQ ID NO: 2841 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggaggacacuuuugccaann

SEQ ID NO: 2842 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggcaaaaguguccucccnn

SEQ ID NO: 2843 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggacacuuuugccaaunn

SEQ ID NO: 2844 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuggcaaaaguguccuccnn

SEQ ID NO: 2845 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggacacuuuugccaaugann

SEQ ID NO: 2846 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauuggcaaaaguguccunn

SEQ ID NO: 2847 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacacuuuugccaaugaann

SEQ ID NO: 2848 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucauuggcaaaaguguccnn

SEQ ID NO: 2849 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugauuagugucuaaggann

SEQ ID NO: 2850 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuuagacacuaaucagcnn

SEQ ID NO: 2851 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuguugcccuuuuccuunn

SEQ ID NO: 2852 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaggaaaagggcaacaguann

SEQ ID NO: 2853 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguugcccuuuuccuugann

SEQ ID NO: 2854 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaggaaaagggcaacagnn

SEQ ID NO: 2855 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguugcccuuuuccuugacnn

SEQ ID NO: 2856 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaaggaaaagggcaacann

SEQ ID NO: 2857 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuugacuauuacacugccnn

SEQ ID NO: 2858 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcaguguaauagucaaggnn

SEQ ID NO: 2859 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuacacugccuggaggann

SEQ ID NO: 2860 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuccaggcaguguaauann

SEQ ID NO: 2861 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuacacugccuggaggaunn

SEQ ID NO: 2862 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccuccaggcaguguaaunn

SEQ ID NO: 2863 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuacacugccuggaggauann

SEQ ID NO: 2864 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauccuccaggcaguguaann

SEQ ID NO: 2865 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacacugccuggaggauagnn

SEQ ID NO: 2866 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuauccuccaggcaguguann

SEQ ID NO: 2867 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauucaaaaagccaaaaunn

SEQ ID NO: 2868 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuuggcuuuuugaaugann

SEQ ID NO: 2869 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaaagccaaaauagagann

SEQ ID NO: 2870 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucuauuuuggcuuuuugnn

SEQ ID NO: 2871 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaagccaaaauagagagunn

SEQ ID NO: 2872 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acucucuauuuuggcuuuunn

SEQ ID NO: 2873 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaguccuagagaauuccunn

SEQ ID NO: 2874 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaauucucuaggacugunn

SEQ ID NO: 2875 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuuguucagaucucauann

SEQ ID NO: 2876 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaugagaucugaacaaauann

SEQ ID NO: 2877 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuguucagaucucauagann

SEQ ID NO: 2878 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuaugagaucugaacaaann

SEQ ID NO: 2879 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuguucagaucucauagaunn

SEQ ID NO: 2880 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuaugagaucugaacaann

SEQ ID NO: 2881 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuugacauccagcaguccnn

SEQ ID NO: 2882 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacugcuggaugucaaaann

SEQ ID NO: 2883 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugacauccagcaguccann

SEQ ID NO: 2884 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggacugcuggaugucaaann

SEQ ID NO: 2885 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugacauccagcaguccaann

SEQ ID NO: 2886 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggacugcuggaugucaann

SEQ ID NO: 2887 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuucugucggggcagccnn

SEQ ID NO: 2888 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugccccgacagaagcann

SEQ ID NO: 2889 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaauauuacuauaauugagnn

SEQ ID NO: 2890 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucaauuauaguaauauuunn

SEQ ID NO: 2891 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauauuacuauaauugagann

SEQ ID NO: 2892 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucaauuauaguaauauunn

SEQ ID NO: 2893 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuacuauaauugagaacunn

SEQ ID NO: 2894 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguucucaauuauaguaaunn

SEQ ID NO: 2895 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuucugucggggcagcccnn

SEQ ID NO: 2896 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcugccccgacagaagcnn

SEQ ID NO: 2897 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuacuauaauugagaacuann

SEQ ID NO: 2898 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaguucucaauuauaguaann

SEQ ID NO: 2899 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuauaauugagaacuacann

SEQ ID NO: 2900 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaguucucaauuauagunn

SEQ ID NO: 2901 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauaauugagaacuacagcnn

SEQ ID NO: 2902 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuguaguucucaauuauann

SEQ ID NO: 2903 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auaauugagaacuacagcunn

SEQ ID NO: 2904 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuguaguucucaauuaunn

SEQ ID NO: 2905 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaauugagaacuacagcuunn

SEQ ID NO: 2906 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcuguaguucucaauuann

SEQ ID NO: 2907 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugagaacuacagcuuuuann

SEQ ID NO: 2908 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaagcuguaguucucaann

SEQ ID NO: 2909 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagaacuacagcuuuuaann

SEQ ID NO: 2910 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaaaagcuguaguucucann

SEQ ID NO: 2911 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaacuacagcuuuuaagann

SEQ ID NO: 2912 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuaaaagcuguaguucunn

SEQ ID NO: 2913 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacagcuuuuaagauugunn

SEQ ID NO: 2914 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaaucuuaaaagcuguagnn

SEQ ID NO: 2915 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucugucggggcagcccgcnn

SEQ ID NO: 2916 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgggcugccccgacagaann

SEQ ID NO: 2917 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuuuaagauuguacuuunn

SEQ ID NO: 2918 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaguacaaucuuaaaagcnn

SEQ ID NO: 2919 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuaagauuguacuuuunn

SEQ ID NO: 2920 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaguacaaucuuaaaagnn

SEQ ID NO: 2921 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuaagauuguacuuuuann

SEQ ID NO: 2922 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaaguacaaucuuaaaann

SEQ ID NO: 2923 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaagauuguacuuuuaunn

SEQ ID NO: 2924 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auaaaaguacaaucuuaaann

SEQ ID NO: 2925 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaagauuguacuuuuaucnn

SEQ ID NO: 2926 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauaaaaguacaaucuuaann

SEQ ID NO: 2927 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauuguacuuuuaucuuann

SEQ ID NO: 2928 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagauaaaaguacaaucunn

SEQ ID NO: 2929 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuguacuuuuaucuuaaaann

SEQ ID NO: 2930 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuaagauaaaaguacaann

SEQ ID NO: 2931 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuuuuaucuuaaaagggunn

SEQ ID NO: 2932 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccuuuuaagauaaaagunn

SEQ ID NO: 2933 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuaucuuaaaagggugnn

SEQ ID NO: 2934 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacccuuuuaagauaaaagnn

SEQ ID NO: 2935 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugucggggcagcccgccunn

SEQ ID NO: 2936 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcgggcugccccgacagnn

SEQ ID NO: 2937 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuaaaagggugguaguuunn

SEQ ID NO: 2938 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacuaccacccuuuuaagnn

SEQ ID NO: 2939 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuaaaauacuuauuaugnn

SEQ ID NO: 2940 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauaauaaguauuuuagggnn

SEQ ID NO: 2941 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuaaaauacuuauuaugunn

SEQ ID NO: 2942 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acauaauaaguauuuuaggnn

SEQ ID NO: 2943 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaauacuuauuauguaann

SEQ ID NO: 2944 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuacauaauaaguauuuuann

SEQ ID NO: 2945 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaauacuuauuauguaagnn

SEQ ID NO: 2946 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuacauaauaaguauuuunn

SEQ ID NO: 2947 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaauacuuauuauguaaggnn

SEQ ID NO: 2948 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuacauaauaaguauuunn

SEQ ID NO: 2949 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucggggcagcccgccuccgnn

SEQ ID NO: 2950 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggaggcgggcugccccgann

SEQ ID NO: 2951 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuauuauguaagggucauunn

SEQ ID NO: 2952 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugacccuuacauaauaann

SEQ ID NO: 2953 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuauguaagggucauuann

SEQ ID NO: 2954 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaugacccuuacauaauann

SEQ ID NO: 2955 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggggcagcccgccuccgcnn

SEQ ID NO: 2956 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggaggcgggcugccccgnn

SEQ ID NO: 2957 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauuagacaaaugucuugnn

SEQ ID NO: 2958 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagacauuugucuaaugann

SEQ ID NO: 2959 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuagacaaaugucuugaann

SEQ ID NO: 2960 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucaagacauuugucuaaunn

SEQ ID NO: 2961 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacaaaugucuugaaguann

SEQ ID NO: 2962 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuucaagacauuugucunn

SEQ ID NO: 2963 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacaaaugucuugaaguagnn

SEQ ID NO: 2964 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacuucaagacauuugucnn

SEQ ID NO: 2965 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaaaugucuugaaguagann

SEQ ID NO: 2966 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuacuucaagacauuugunn

SEQ ID NO: 2967 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augaaugguucuuuaucaunn

SEQ ID NO: 2968 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augauaaagaaccauucaunn

SEQ ID NO: 2969 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugguucuuuaucauuucnn

SEQ ID NO: 2970 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaaugauaaagaaccauunn

SEQ ID NO: 2971 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augguucuuuaucauuucunn

SEQ ID NO: 2972 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaaugauaaagaaccaunn

SEQ ID NO: 2973 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguucuuuaucauuucucnn

SEQ ID NO: 2974 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaaugauaaagaaccann

SEQ ID NO: 2975 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucuuuaucauuucucuunn

SEQ ID NO: 2976 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagagaaaugauaaagaacnn

SEQ ID NO: 2977 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaucauuucucuucccccnn

SEQ ID NO: 2978 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggggaagagaaaugauaann

SEQ ID NO: 2979 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaucauuucucuucccccunn

SEQ ID NO: 2980 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggggaagagaaaugauann

SEQ ID NO: 2981 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuucucuucccccuuuunn

SEQ ID NO: 2982 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaagggggaagagaaaugnn

SEQ ID NO: 2983 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucucuucccccuuuuugnn

SEQ ID NO: 2984 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaaagggggaagagaaann

SEQ ID NO: 2985 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucuucccccuuuuuggnn

SEQ ID NO: 2986 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaaaaagggggaagagaann

SEQ ID NO: 2987 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucccccuuuuuggcaucnn

SEQ ID NO: 2988 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaugccaaaaagggggaagnn

SEQ ID NO: 2989 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccccuuuuuggcauccugnn

SEQ ID NO: 2990 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggaugccaaaaagggggnn

SEQ ID NO: 2991 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuuggcauccuggcuugnn

SEQ ID NO: 2992 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagccaggaugccaaaaann

SEQ ID NO: 2993 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuggcauccuggcuugcnn

SEQ ID NO: 2994 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaagccaggaugccaaaann

SEQ ID NO: 2995 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuggcauccuggcuugccnn

SEQ ID NO: 2996 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcaagccaggaugccaaann

SEQ ID NO: 2997 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggcauccuggcuugccunn

SEQ ID NO: 2998 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcaagccaggaugccaann

SEQ ID NO: 2999 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcauccuggcuugccuccnn

SEQ ID NO: 3000 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggcaagccaggaugccnn

SEQ ID NO: 3001 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauccuggcuugccuccann

SEQ ID NO: 3002 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaggcaagccaggaugcnn

SEQ ID NO: 3003 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccuggcuugccuccagunn

SEQ ID NO: 3004 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuggaggcaagccaggaunn

SEQ ID NO: 3005 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggcuugccuccaguuuunn

SEQ ID NO: 3006 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaacuggaggcaagccagnn

SEQ ID NO: 3007 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcuugccuccaguuuuann

SEQ ID NO: 3008 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaacuggaggcaagccann

SEQ ID NO: 3009 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccuccaguuuuagguccnn

SEQ ID NO: 3010 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaccuaaaacuggaggcann

SEQ ID NO: 3011 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaguuugcuucuguaagcann

SEQ ID NO: 3012 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuuacagaagcaaacuann

SEQ ID NO: 3013 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuugcuucuguaagcaann

SEQ ID NO: 3014 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcuuacagaagcaaacunn

SEQ ID NO: 3015 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accugcugagggggcucuunn

SEQ ID NO: 3016 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagagcccccucagcaggunn

SEQ ID NO: 3017 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcugagggggcucuuucnn

SEQ ID NO: 3018 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaagagcccccucagcagnn

SEQ ID NO: 3019 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcugagggggcucuuuccnn

SEQ ID NO: 3020 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaaagagcccccucagcann

SEQ ID NO: 3021 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugagggggcucuuucccnn

SEQ ID NO: 3022 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggaaagagcccccucagcnn

SEQ ID NO: 3023 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagggggcucuuucccunn

SEQ ID NO: 3024 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggaaagagcccccucagnn

SEQ ID NO: 3025 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagggggcucuuucccucnn

SEQ ID NO: 3026 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagggaaagagcccccucann

SEQ ID NO: 3027 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaguaagaucaagaaucuunn

SEQ ID NO: 3028 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagauucuugaucuuacuunn

SEQ ID NO: 3029 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguaagaucaagaaucuuunn

SEQ ID NO: 3030 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagauucuugaucuuacunn

SEQ ID NO: 3031 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaagaucaagaaucuuuunn

SEQ ID NO: 3032 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaagauucuugaucuuacnn

SEQ ID NO: 3033 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagaucaagaaucuuuugnn

SEQ ID NO: 3034 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaagauucuugaucuuann

SEQ ID NO: 3035 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaucaagaaucuuuugunn

SEQ ID NO: 3036 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaaaagauucuugaucuunn

SEQ ID NO: 3037 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaucaagaaucuuuugugnn

SEQ ID NO: 3038 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacaaaagauucuugaucunn

SEQ ID NO: 3039 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaagaaucuuuugugaaann

SEQ ID NO: 3040 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucacaaaagauucuugann

SEQ ID NO: 3041 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagaaauuuacuauguaaann

SEQ ID NO: 3042 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuacauaguaaauuucuann

SEQ ID NO: 3043 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaauuuacuauguaaaunn

SEQ ID NO: 3044 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuacauaguaaauuucunn

SEQ ID NO: 3045 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaauuuacuauguaaaugnn

SEQ ID NO: 3046 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuuacauaguaaauuucnn

SEQ ID NO: 3047 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaauuuacuauguaaaugcnn

SEQ ID NO: 3048 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauuuacauaguaaauuunn

SEQ ID NO: 3049 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuacuauguaaaugcuunn

SEQ ID NO: 3050 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcauuuacauaguaaaunn

SEQ ID NO: 3051 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuacuauguaaaugcuugnn

SEQ ID NO: 3052 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagcauuuacauaguaaann

SEQ ID NO: 3053 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuauguaaaugcuugaunn

SEQ ID NO: 3054 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucaagcauuuacauaguann

SEQ ID NO: 3055 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuauguaaaugcuugauggnn

SEQ ID NO: 3056 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaucaagcauuuacauagnn

SEQ ID NO: 3057 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auguaaaugcuugauggaann

SEQ ID NO: 3058 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccaucaagcauuuacaunn

SEQ ID NO: 3059 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaaaugcuugauggaaunn

SEQ ID NO: 3060 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuccaucaagcauuuacann

SEQ ID NO: 3061 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaaaugcuugauggaauunn

SEQ ID NO: 3062 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuccaucaagcauuuacnn

SEQ ID NO: 3063 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugcuugauggaauuuuunn

SEQ ID NO: 3064 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaauuccaucaagcauunn

SEQ ID NO: 3065 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augcuugauggaauuuuuunn

SEQ ID NO: 3066 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaaauuccaucaagcaunn

SEQ ID NO: 3067 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuugauggaauuuuuucnn

SEQ ID NO: 3068 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaaaaauuccaucaagcann

SEQ ID NO: 3069 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuugauggaauuuuuuccnn

SEQ ID NO: 3070 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaaaaaauuccaucaagcnn

SEQ ID NO: 3071 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaauuuuuuccugcuagunn

SEQ ID NO: 3072 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuagcaggaaaaaauuccnn

SEQ ID NO: 3073 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuuuuccugcuaguguann

SEQ ID NO: 3074 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacacuagcaggaaaaaaunn

SEQ ID NO: 3075 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugcuaguguagcuucugnn

SEQ ID NO: 3076 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaagcuacacuagcaggnn

SEQ ID NO: 3077 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuaguguagcuucugann

SEQ ID NO: 3078 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagaagcuacacuagcagnn

SEQ ID NO: 3079 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuaguguagcuucugaaann

SEQ ID NO: 3080 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucagaagcuacacuagcnn

SEQ ID NO: 3081 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaguguagcuucugaaagnn

SEQ ID NO: 3082 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuucagaagcuacacuagnn

SEQ ID NO: 3083 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaguguagcuucugaaaggnn

SEQ ID NO: 3084 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuucagaagcuacacuann

SEQ ID NO: 3085 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguguagcuucugaaaggunn

SEQ ID NO: 3086 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accuuucagaagcuacacunn

SEQ ID NO: 3087 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guguagcuucugaaaggugnn

SEQ ID NO: 3088 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caccuuucagaagcuacacnn

SEQ ID NO: 3089 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guagcuucugaaaggugcunn

SEQ ID NO: 3090 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaccuuucagaagcuacnn

SEQ ID NO: 3091 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuucugaaaggugcuuucnn

SEQ ID NO: 3092 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaagcaccuuucagaagcnn

SEQ ID NO: 3093 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuauuuaaaacuacccaunn

SEQ ID NO: 3094 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggguaguuuuaaauaaann

SEQ ID NO: 3095 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuauuuaaaacuacccaugnn

SEQ ID NO: 3096 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauggguaguuuuaaauaann

SEQ ID NO: 3097 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuaaaacuacccaugcann

SEQ ID NO: 3098 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcauggguaguuuuaaaunn

SEQ ID NO: 3099 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaaaacuacccaugcaann

SEQ ID NO: 3100 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcauggguaguuuuaaann

SEQ ID NO: 3101 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaacuacccaugcaauuann

SEQ ID NO: 3102 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaauugcauggguaguuuunn

SEQ ID NO: 3103 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacccaugcaauuaaaagnn

SEQ ID NO: 3104 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuaauugcauggguagnn

SEQ ID NO: 3105 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacccaugcaauuaaaaggnn

SEQ ID NO: 3106 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuuuaauugcauggguann

SEQ ID NO: 3107 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccaugcaauuaaaagguann

SEQ ID NO: 3108 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccuuuuaauugcaugggnn

SEQ ID NO: 3109 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augcaauuaaaagguacaann

SEQ ID NO: 3110 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuguaccuuuuaauugcaunn

SEQ ID NO: 3111 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcaauuaaaagguacaaunn

SEQ ID NO: 3112 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuguaccuuuuaauugcann

SEQ ID NO: 3113 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaauuaaaagguacaaugnn

SEQ ID NO: 3114 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuguaccuuuuaauugcnn

SEQ ID NO: 3115 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caauuaaaagguacaaugcnn

SEQ ID NO: 3116 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauuguaccuuuuaauugnn

SEQ ID NO: 3117 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaggcccugccgcucaunn

SEQ ID NO: 3118 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augagcggcagggccuggcnn

SEQ ID NO: 3119 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaggcccugccgcucaugnn

SEQ ID NO: 3120 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caugagcggcagggccuggnn

SEQ ID NO: 3121 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggcccugccgcucauggnn

SEQ ID NO: 3122 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaugagcggcagggccugnn

SEQ ID NO: 3123 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcccugccgcucauggunn

SEQ ID NO: 3124 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accaugagcggcagggccunn

SEQ ID NO: 3125 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccgcucauggugccagcnn

SEQ ID NO: 3126 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuggcaccaugagcggcann

SEQ ID NO: 3127 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgcucauggugccagcccnn

SEQ ID NO: 3128 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcuggcaccaugagcggnn

SEQ ID NO: 3129 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgcucauggugccagcccann

SEQ ID NO: 3130 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugggcuggcaccaugagcgnn

SEQ ID NO: 3131 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcucauggugccagcccagnn

SEQ ID NO: 3132 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugggcuggcaccaugagcnn

SEQ ID NO: 3133 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccggaggcagcgagcggnn

SEQ ID NO: 3134 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgctcgctgcctccgggcnn

SEQ ID NO: 3135 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccggaggcagcgagcgggnn

SEQ ID NO: 3136 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccgctcgctgcctccgggnn

SEQ ID NO: 3137 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcagcgagcggggggcugnn

SEQ ID NO: 3138 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagccccccgcucgcugccnn

SEQ ID NO: 3139 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagcgagcggggggcugcnn

SEQ ID NO: 3140 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagccccccgcucgcugcnn

SEQ ID NO: 3141 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcgagcggggggcugccnn

SEQ ID NO: 3142 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcagccccccgcucgcugnn

SEQ ID NO: 3143 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcgagcggggggcugcccnn

SEQ ID NO: 3144 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcagccccccgcucgcunn

SEQ ID NO: 3145 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggggcugccccaggcgcnn

SEQ ID NO: 3146 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgccuggggcagccccccnn

SEQ ID NO: 3147 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggggcugccccaggcgcgnn

SEQ ID NO: 3148 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgcgccuggggcagcccccnn

SEQ ID NO: 3149 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcugccccaggcgcgcnn

SEQ ID NO: 3150 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgcgccuggggcagccccnn

SEQ ID NO: 3151 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccccaggcgcgcaagcnn

SEQ ID NO: 3152 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuugcgcgccuggggcagnn

SEQ ID NO: 3153 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccccgaggagaaggcgcnn

SEQ ID NO: 3154 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgccttctcctcggggctnn

SEQ ID NO: 3155 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggagaaggcgcugaggann

SEQ ID NO: 3156 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccucagcgccuucuccucnn

SEQ ID NO: 3157 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcgcugaggaggaaacunn

SEQ ID NO: 3158 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuuccuccucagcgccunn

SEQ ID NO: 3159 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcgcugaggaggaaacugnn

SEQ ID NO: 3160 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguuuccuccucagcgccnn

SEQ ID NO: 3161 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacagaguagcagcucagnn

SEQ ID NO: 3162 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagcugcuacucuguuunn

SEQ ID NO: 3163 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacagaguagcagcucagann

SEQ ID NO: 3164 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugagcugcuacucuguunn

SEQ ID NO: 3165 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagaguagcagcucagacnn

SEQ ID NO: 3166 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucugagcugcuacucugunn

SEQ ID NO: 3167 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcagcucagacugccagann

SEQ ID NO: 3168 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggcagucugagcugcunn

SEQ ID NO: 3169 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagcucagacugccagagnn

SEQ ID NO: 3170 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuggcagucugagcugcnn

SEQ ID NO: 3171 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcucagacugccagagann

SEQ ID NO: 3172 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucuggcagucugagcugnn

SEQ ID NO: 3173 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcucagacugccagagaucnn

SEQ ID NO: 3174 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucucuggcagucugagcnn

SEQ ID NO: 3175 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacugccagagaucgaaagnn

SEQ ID NO: 3176 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuucgaucucuggcagucnn

SEQ ID NO: 3177 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagugagcuggaacagcann

SEQ ID NO: 3178 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuguuccagcucacucann

SEQ ID NO: 3179 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuggaacagcaagugguann

SEQ ID NO: 3180 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccacuugcuguuccagcnn

SEQ ID NO: 3181 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaacagcaagugguagnn

SEQ ID NO: 3182 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaccacuugcuguuccagnn

SEQ ID NO: 3183 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagcaagugguagauuuann

SEQ ID NO: 3184 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaucuaccacuugcugunn

SEQ ID NO: 3185 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcaagugguagauuuagnn

SEQ ID NO: 3186 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaaaucuaccacuugcugnn

SEQ ID NO: 3187 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaagugguagauuuagaann

SEQ ID NO: 3188 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuaaaucuaccacuugcnn

SEQ ID NO: 3189 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagugguagauuuagaagnn

SEQ ID NO: 3190 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucuaaaucuaccacuugnn

SEQ ID NO: 3191 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugguagauuuagaagaagnn

SEQ ID NO: 3192 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucuucuaaaucuaccacnn

SEQ ID NO: 3193 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguagauuuagaagaagann

SEQ ID NO: 3194 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucuucuaaaucuaccann

SEQ ID NO: 3195 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguagauuuagaagaagagnn

SEQ ID NO: 3196 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuucuucuaaaucuaccnn

SEQ ID NO: 3197 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guagauuuagaagaagagann

SEQ ID NO: 3198 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucuucuucuaaaucuacnn

SEQ ID NO: 3199 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagaagaagagaaccaaann

SEQ ID NO: 3200 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugguucucuucuucuaann

SEQ ID NO: 3201 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaagagaaccaaaaacuunn

SEQ ID NO: 3202 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaguuuuugguucucuucunn

SEQ ID NO: 3203 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagaaccaaaaacuuuugnn

SEQ ID NO: 3204 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaaguuuuugguucucunn

SEQ ID NO: 3205 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaccaaaaacuuuugcnn

SEQ ID NO: 3206 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaaaaguuuuugguucucnn

SEQ ID NO: 3207 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaccaaaaacuuuugcuann

SEQ ID NO: 3208 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagcaaaaguuuuugguucnn

SEQ ID NO: 3209 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaaacuuuugcuagaaann

SEQ ID NO: 3210 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucuagcaaaaguuuuugnn

SEQ ID NO: 3211 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuuuugcuagaaaaucagnn

SEQ ID NO: 3212 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugauuuucuagcaaaagunn

SEQ ID NO: 3213 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugcuagaaaaucagcuunn

SEQ ID NO: 3214 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcugauuuucuagcaaann

SEQ ID NO: 3215 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuagaaaaucagcuuuuacnn

SEQ ID NO: 3216 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaaaagcugauuuucuagnn

SEQ ID NO: 3217 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaucagcuuuuacgagann

SEQ ID NO: 3218 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucguaaaagcugauuuunn

SEQ ID NO: 3219 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucagcuuuuacgagagann

SEQ ID NO: 3220 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucucguaaaagcugauunn

SEQ ID NO: 3221 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagcuuuuacgagagaaann

SEQ ID NO: 3222 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucucucguaaaagcugann

SEQ ID NO: 3223 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuacgagagaaaacucnn

SEQ ID NO: 3224 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaguuuucucucguaaaagnn

SEQ ID NO: 3225 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccuuguaguugagaaccnn

SEQ ID NO: 3226 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguucucaacuacaaggccnn

SEQ ID NO: 3227 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuuguaguugagaaccann

SEQ ID NO: 3228 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguucucaacuacaaggcnn

SEQ ID NO: 3229 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuguaguugagaaccagnn

SEQ ID NO: 3230 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugguucucaacuacaaggnn

SEQ ID NO: 3231 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuguaguugagaaccaggann

SEQ ID NO: 3232 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccugguucucaacuacaann

SEQ ID NO: 3233 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaguugagaaccaggaguunn

SEQ ID NO: 3234 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuccugguucucaacuann

SEQ ID NO: 3235 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguugagaaccaggaguuann

SEQ ID NO: 3236 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaacuccugguucucaacunn

SEQ ID NO: 3237 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagaaccaggaguuaagann

SEQ ID NO: 3238 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuaacuccugguucucann

SEQ ID NO: 3239 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaccaggaguuaagacnn

SEQ ID NO: 3240 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucuuaacuccugguucucnn

SEQ ID NO: 3241 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaccaggaguuaagacann

SEQ ID NO: 3242 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucuuaacuccugguucunn

SEQ ID NO: 3243 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaccaggaguuaagacagnn

SEQ ID NO: 3244 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugucuuaacuccugguucnn

SEQ ID NO: 3245 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaccaggaguuaagacagcnn

SEQ ID NO: 3246 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugucuuaacuccugguunn

SEQ ID NO: 3247 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggauggaugcccugguunn

SEQ ID NO: 3248 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaccagggcauccauccccnn

SEQ ID NO: 3249 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggauggaugcccugguugnn

SEQ ID NO: 3250 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaccagggcauccaucccnn

SEQ ID NO: 3251 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauggaugcccugguugcunn

SEQ ID NO: 3252 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaaccagggcauccaucnn

SEQ ID NO: 3253 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggcggaagccaaggggnn

SEQ ID NO: 3254 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccttggcttccgcctccnn

SEQ ID NO: 3255 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugaggccaguggccgggnn

SEQ ID NO: 3256 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccggccacuggccucacunn

SEQ ID NO: 3257 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggccaguggccgggucunn

SEQ ID NO: 3258 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacccggccacuggccucnn

SEQ ID NO: 3259 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggccaguggccgggucugnn

SEQ ID NO: 3260 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagacccggccacuggccunn

SEQ ID NO: 3261 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccaguggccgggucugcnn

SEQ ID NO: 3262 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagacccggccacuggccnn

SEQ ID NO: 3263 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaguggccgggucugcunn

SEQ ID NO: 3264 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcagacccggccacuggcnn

SEQ ID NO: 3265 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guggccgggucugcugagunn

SEQ ID NO: 3266 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acucagcagacccggccacnn

SEQ ID NO: 3267 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggccgggucugcugagucnn

SEQ ID NO: 3268 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacucagcagacccggccann

SEQ ID NO: 3269 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccgggucugcugaguccgnn

SEQ ID NO: 3270 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggacucagcagacccggcnn

SEQ ID NO: 3271 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcccaguugucaccccunn

SEQ ID NO: 3272 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggggugacaacugggccunn

SEQ ID NO: 3273 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccaguugucaccccuccann

SEQ ID NO: 3274 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaggggugacaacugggnn

SEQ ID NO: 3275 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaguugucaccccuccagnn

SEQ ID NO: 3276 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaggggugacaacuggnn

SEQ ID NO: 3277 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguugucaccccuccagann

SEQ ID NO: 3278 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggaggggugacaacugnn

SEQ ID NO: 3279 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguugucaccccuccagaann

SEQ ID NO: 3280 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuggaggggugacaacunn

SEQ ID NO: 3281 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guugucaccccuccagaacnn

SEQ ID NO: 3282 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucuggaggggugacaacnn

SEQ ID NO: 3283 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugucaccccuccagaacann

SEQ ID NO: 3284 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguucuggaggggugacaann

SEQ ID NO: 3285 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucaccccuccagaacaunn

SEQ ID NO: 3286 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auguucuggaggggugacann

SEQ ID NO: 3287 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaccccuccagaacaucnn

SEQ ID NO: 3288 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauguucuggaggggugacnn

SEQ ID NO: 3289 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaccccuccagaacaucunn

SEQ ID NO: 3290 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauguucuggaggggugann

SEQ ID NO: 3291 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caccccuccagaacaucucnn

SEQ ID NO: 3292 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagauguucuggaggggugnn

SEQ ID NO: 3293 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accccuccagaacaucuccnn

SEQ ID NO: 3294 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggagauguucuggaggggunn

SEQ ID NO: 3295 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagaacaucuccccauggnn

SEQ ID NO: 3296 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccauggggagauguucuggnn

SEQ ID NO: 3297 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacaucuccccauggauunn

SEQ ID NO: 3298 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauccauggggagauguucnn

SEQ ID NO: 3299 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucuccccauggauucugnn

SEQ ID NO: 3300 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaauccauggggagaugnn

SEQ ID NO: 3301 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggcgguauugacucuucnn

SEQ ID NO: 3302 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagagucaauaccgccagnn

SEQ ID NO: 3303 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcgguauugacucuucann

SEQ ID NO: 3304 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaagagucaauaccgccann

SEQ ID NO: 3305 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgguauugacucuucagann

SEQ ID NO: 3306 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugaagagucaauaccgcnn

SEQ ID NO: 3307 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgguauugacucuucagaunn

SEQ ID NO: 3308 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucugaagagucaauaccgnn

SEQ ID NO: 3309 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguauugacucuucagauunn

SEQ ID NO: 3310 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaucugaagagucaauaccnn

SEQ ID NO: 3311 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guauugacucuucagauucnn

SEQ ID NO: 3312 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaucugaagagucaauacnn

SEQ ID NO: 3313 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauugacucuucagauucann

SEQ ID NO: 3314 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaucugaagagucaauann

SEQ ID NO: 3315 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacucuucagauucagagnn

SEQ ID NO: 3316 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugaaucugaagagucann

SEQ ID NO: 3317 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuucagauucagagucunn

SEQ ID NO: 3318 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacucugaaucugaagagnn

SEQ ID NO: 3319 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucagauucagagucugann

SEQ ID NO: 3320 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagacucugaaucugaagnn

SEQ ID NO: 3321 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagauucagagucugauaunn

SEQ ID NO: 3322 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auaucagacucugaaucugnn

SEQ ID NO: 3323 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauucagagucugauaucnn

SEQ ID NO: 3324 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauaucagacucugaaucunn

SEQ ID NO: 3325 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauucagagucugauauccnn

SEQ ID NO: 3326 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggauaucagacucugaaucnn

SEQ ID NO: 3327 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagagucugauauccugunn

SEQ ID NO: 3328 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaggauaucagacucugann

SEQ ID NO: 3329 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagagucugauauccuguunn

SEQ ID NO: 3330 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacaggauaucagacucugnn

SEQ ID NO: 3331 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagucugauauccuguugnn

SEQ ID NO: 3332 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caacaggauaucagacucunn

SEQ ID NO: 3333 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucugauauccuguugggnn

SEQ ID NO: 3334 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccaacaggauaucagacunn

SEQ ID NO: 3335 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugauauccuguugggcaunn

SEQ ID NO: 3336 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augcccaacaggauaucagnn

SEQ ID NO: 3337 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugauauccuguugggcauunn

SEQ ID NO: 3338 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugcccaacaggauaucann

SEQ ID NO: 3339 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauccuguugggcauucugnn

SEQ ID NO: 3340 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaaugcccaacaggauann

SEQ ID NO: 3341 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguugggcauucuggacaann

SEQ ID NO: 3342 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuguccagaaugcccaacann

SEQ ID NO: 3343 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guugggcauucuggacaacnn

SEQ ID NO: 3344 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuguccagaaugcccaacnn

SEQ ID NO: 3345 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugggcauucuggacaacunn

SEQ ID NO: 3346 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuguccagaaugcccaann

SEQ ID NO: 3347 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcauucuggacaacuuggnn

SEQ ID NO: 3348 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaaguuguccagaaugccnn

SEQ ID NO: 3349 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcauucuggacaacuuggann

SEQ ID NO: 3350 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccaaguuguccagaaugcnn

SEQ ID NO: 3351 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggacaacuuggacccann

SEQ ID NO: 3352 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggguccaaguuguccagann

SEQ ID NO: 3353 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacaacuuggacccagucnn

SEQ ID NO: 3354 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacuggguccaaguuguccnn

SEQ ID NO: 3355 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuuggacccagucauguunn

SEQ ID NO: 3356 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacaugacuggguccaagunn

SEQ ID NO: 3357 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuggacccagucauguucnn

SEQ ID NO: 3358 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacaugacuggguccaagnn

SEQ ID NO: 3359 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggacccagucauguucuunn

SEQ ID NO: 3360 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaacaugacuggguccann

SEQ ID NO: 3361 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacccagucauguucuucnn

SEQ ID NO: 3362 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagaacaugacuggguccnn

SEQ ID NO: 3363 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccagucauguucuucaann

SEQ ID NO: 3364 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugaagaacaugacugggunn

SEQ ID NO: 3365 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucauguucuucaaaugccnn

SEQ ID NO: 3366 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcauuugaagaacaugacnn

SEQ ID NO: 3367 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauguucuucaaaugcccunn

SEQ ID NO: 3368 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggcauuugaagaacaugnn

SEQ ID NO: 3369 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucaaaugcccuuccccann

SEQ ID NO: 3370 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggggaagggcauuugaagnn

SEQ ID NO: 3371 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucaaaugcccuuccccagnn

SEQ ID NO: 3372 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggggaagggcauuugaann

SEQ ID NO: 3373 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaaugcccuuccccagagnn

SEQ ID NO: 3374 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuggggaagggcauuugnn

SEQ ID NO: 3375 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggagcucccagaggucuacnn

SEQ ID NO: 3376 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guagaccucugggagcuccnn

SEQ ID NO: 3377 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcucccagaggucuaccnn

SEQ ID NO: 3378 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguagaccucugggagcucnn

SEQ ID NO: 3379 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcucccagaggucuacccnn

SEQ ID NO: 3380 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggguagaccucugggagcunn

SEQ ID NO: 3381 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucccagaggucuacccagann

SEQ ID NO: 3382 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggguagaccucugggann

SEQ ID NO: 3383 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccagaggucuacccagaann

SEQ ID NO: 3384 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuggguagaccucugggnn

SEQ ID NO: 3385 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagaggucuacccagaagnn

SEQ ID NO: 3386 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucuggguagaccucuggnn

SEQ ID NO: 3387 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaggucuacccagaaggann

SEQ ID NO: 3388 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuucuggguagaccucunn

SEQ ID NO: 3389 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggucuacccagaaggacnn

SEQ ID NO: 3390 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guccuucuggguagaccucnn

SEQ ID NO: 3391 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggucuacccagaaggaccnn

SEQ ID NO: 3392 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguccuucuggguagaccunn

SEQ ID NO: 3393 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggucuacccagaaggacccnn

SEQ ID NO: 3394 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggguccuucuggguagaccnn

SEQ ID NO: 3395 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccagaaggacccaguucnn

SEQ ID NO: 3396 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacuggguccuucugggunn

SEQ ID NO: 3397 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccagaaggacccaguuccnn

SEQ ID NO: 3398 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaacuggguccuucugggnn

SEQ ID NO: 3399 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagaaggacccaguuccunn

SEQ ID NO: 3400 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaacuggguccuucuggnn

SEQ ID NO: 3401 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaaggacccaguuccuunn

SEQ ID NO: 3402 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaggaacuggguccuucugnn

SEQ ID NO: 3403 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaggacccaguuccuuann

SEQ ID NO: 3404 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaggaacuggguccuucunn

SEQ ID NO: 3405 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggacccaguuccuuaccagnn

SEQ ID NO: 3406 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugguaaggaacuggguccnn

SEQ ID NO: 3407 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccaguuccuuaccagccnn

SEQ ID NO: 3408 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugguaaggaacugggunn

SEQ ID NO: 3409 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccaguuccuuaccagccunn

SEQ ID NO: 3410 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcugguaaggaacugggnn

SEQ ID NO: 3411 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaguuccuuaccagccucnn

SEQ ID NO: 3412 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggcugguaaggaacuggnn

SEQ ID NO: 3413 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguuccuuaccagccuccnn

SEQ ID NO: 3414 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggcugguaaggaacugnn

SEQ ID NO: 3415 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuccuuaccagccucccnn

SEQ ID NO: 3416 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggaggcugguaaggaacunn

SEQ ID NO: 3417 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuaccagccucccuuucunn

SEQ ID NO: 3418 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaagggaggcugguaagnn

SEQ ID NO: 3419 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaccagccucccuuucucunn

SEQ ID NO: 3420 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagaaagggaggcugguann

SEQ ID NO: 3421 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccucccuuucucugucann

SEQ ID NO: 3422 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacagagaaagggaggcunn

SEQ ID NO: 3423 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuucucugucaguggggnn

SEQ ID NO: 3424 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccacugacagagaaaggnn

SEQ ID NO: 3425 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugucaguggggacgucaunn

SEQ ID NO: 3426 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augacguccccacugacagnn

SEQ ID NO: 3427 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucaguggggacgucaucnn

SEQ ID NO: 3428 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaugacguccccacugacann

SEQ ID NO: 3429 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaguggggacgucaucagnn

SEQ ID NO: 3430 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaugacguccccacugann

SEQ ID NO: 3431 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggggacgucaucagccaann

SEQ ID NO: 3432 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggcugaugacguccccann

SEQ ID NO: 3433 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggacgucaucagccaagcnn

SEQ ID NO: 3434 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuggcugaugacgucccnn

SEQ ID NO: 3435 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacgucaucagccaagcugnn

SEQ ID NO: 3436 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcuuggcugaugacgucnn

SEQ ID NO: 3437 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acgucaucagccaagcuggnn

SEQ ID NO: 3438 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagcuuggcugaugacgunn

SEQ ID NO: 3439 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaucagccaagcuggaann

SEQ ID NO: 3440 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccagcuuggcugaugacnn

SEQ ID NO: 3441 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagccaagcuggaagccann

SEQ ID NO: 3442 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcuuccagcuuggcugann

SEQ ID NO: 3443 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccaagcuggaagccauunn

SEQ ID NO: 3444 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauggcuuccagcuuggcunn

SEQ ID NO: 3445 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaagcuggaagccauuann

SEQ ID NO: 3446 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaauggcuuccagcuuggcnn

SEQ ID NO: 3447 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaagcuggaagccauuaann

SEQ ID NO: 3448 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaauggcuuccagcuuggnn

SEQ ID NO: 3449 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagcuggaagccauuaaunn

SEQ ID NO: 3450 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuaauggcuuccagcuugnn

SEQ ID NO: 3451 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcuggaagccauuaaugnn

SEQ ID NO: 3452 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuaauggcuuccagcuunn

SEQ ID NO: 3453 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuggaagccauuaaugann

SEQ ID NO: 3454 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauuaauggcuuccagcunn

SEQ ID NO: 3455 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaagccauuaaugaacnn

SEQ ID NO: 3456 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucauuaauggcuuccagnn

SEQ ID NO: 3457 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaagccauuaaugaacunn

SEQ ID NO: 3458 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguucauuaauggcuuccann

SEQ ID NO: 3459 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccauuaaugaacuaauunn

SEQ ID NO: 3460 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuaguucauuaauggcunn

SEQ ID NO: 3461 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccauuaaugaacuaauucgnn

SEQ ID NO: 3462 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgaauuaguucauuaauggnn

SEQ ID NO: 3463 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cguuuugaccacauauauann

SEQ ID NO: 3464 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauauauguggucaaaacgnn

SEQ ID NO: 3465 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accacauauauaccaagccnn

SEQ ID NO: 3466 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuugguauauauguggunn

SEQ ID NO: 3467 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagauacccucugagacann

SEQ ID NO: 3468 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucucagaggguaucucunn

SEQ ID NO: 3469 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagauacccucugagacagnn

SEQ ID NO: 3470 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugucucagaggguaucucnn

SEQ ID NO: 3471 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauacccucugagacagann

SEQ ID NO: 3472 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugucucagaggguaucunn

SEQ ID NO: 3473 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auacccucugagacagagann

SEQ ID NO: 3474 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucugucucagaggguaunn

SEQ ID NO: 3475 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagagagccaagcuaaugunn

SEQ ID NO: 3476 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acauuagcuuggcucucugnn

SEQ ID NO: 3477 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagagccaagcuaaugugnn

SEQ ID NO: 3478 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacauuagcuuggcucucunn

SEQ ID NO: 3479 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caagcuaaugugguagugann

SEQ ID NO: 3480 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucacuaccacauuagcuugnn

SEQ ID NO: 3481 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcuaaugugguagugaann

SEQ ID NO: 3482 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucacuaccacauuagcuunn

SEQ ID NO: 3483 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaaugugguagugaaaaunn

SEQ ID NO: 3484 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuucacuaccacauuagnn

SEQ ID NO: 3485 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugugguagugaaaaucgnn

SEQ ID NO: 3486 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgauuuucacuaccacauunn

SEQ ID NO: 3487 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augugguagugaaaaucgann

SEQ ID NO: 3488 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucgauuuucacuaccacaunn

SEQ ID NO: 3489 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugguagugaaaaucgaggnn

SEQ ID NO: 3490 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucgauuuucacuaccacnn

SEQ ID NO: 3491 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguagugaaaaucgaggann

SEQ ID NO: 3492 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccucgauuuucacuaccann

SEQ ID NO: 3493 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagugaaaaucgaggaagcnn

SEQ ID NO: 3494 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuccucgauuuucacuann

SEQ ID NO: 3495 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaaaaucgaggaagcaccnn

SEQ ID NO: 3496 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggugcuuccucgauuuucann

SEQ ID NO: 3497 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaucgaggaagcaccucunn

SEQ ID NO: 3498 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaggugcuuccucgauuunn

SEQ ID NO: 3499 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucgaggaagcaccucucann

SEQ ID NO: 3500 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagaggugcuuccucgaunn

SEQ ID NO: 3501 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucgaggaagcaccucucagnn

SEQ ID NO: 3502 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagaggugcuuccucgann

SEQ ID NO: 3503 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgaggaagcaccucucagcnn

SEQ ID NO: 3504 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugagaggugcuuccucgnn

SEQ ID NO: 3505 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaagcaccucucagcccnn

SEQ ID NO: 3506 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcugagaggugcuuccunn

SEQ ID NO: 3507 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaagcaccucucagccccnn

SEQ ID NO: 3508 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcugagaggugcuuccnn

SEQ ID NO: 3509 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accucucagccccucagagnn

SEQ ID NO: 3510 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugaggggcugagaggunn

SEQ ID NO: 3511 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucucagccccucagagann

SEQ ID NO: 3512 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucugaggggcugagaggnn

SEQ ID NO: 3513 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucucagccccucagagaann

SEQ ID NO: 3514 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucugaggggcugagagnn

SEQ ID NO: 3515 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucagccccucagagaaunn

SEQ ID NO: 3516 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucucugaggggcugagann

SEQ ID NO: 3517 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagccccucagagaaugnn

SEQ ID NO: 3518 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauucucugaggggcugagnn

SEQ ID NO: 3519 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagccccucagagaaugann

SEQ ID NO: 3520 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauucucugaggggcugann

SEQ ID NO: 3521 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagccccucagagaaugaunn

SEQ ID NO: 3522 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucauucucugaggggcugnn

SEQ ID NO: 3523 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccccucagagaaugaucnn

SEQ ID NO: 3524 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucauucucugaggggcunn

SEQ ID NO: 3525 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccucagagaaugaucacnn

SEQ ID NO: 3526 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugaucauucucugaggggnn

SEQ ID NO: 3527 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagagaaugaucacccunn

SEQ ID NO: 3528 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggugaucauucucugagnn

SEQ ID NO: 3529 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagagaaugaucacccugnn

SEQ ID NO: 3530 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagggugaucauucucugann

SEQ ID NO: 3531 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagagaaugaucacccugann

SEQ ID NO: 3532 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagggugaucauucucugnn

SEQ ID NO: 3533 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagaaugaucacccugaann

SEQ ID NO: 3534 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucagggugaucauucucunn

SEQ ID NO: 3535 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaugaucacccugaauunn

SEQ ID NO: 3536 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauucagggugaucauucunn

SEQ ID NO: 3537 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaugaucacccugaauucnn

SEQ ID NO: 3538 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauucagggugaucauucnn

SEQ ID NO: 3539 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugaucacccugaauucann

SEQ ID NO: 3540 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaauucagggugaucauunn

SEQ ID NO: 3541 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augaucacccugaauucaunn

SEQ ID NO: 3542 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augaauucagggugaucaunn

SEQ ID NO: 3543 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccugaauucauugucucnn

SEQ ID NO: 3544 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagacaaugaauucagggunn

SEQ ID NO: 3545 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccugaauucauugucucann

SEQ ID NO: 3546 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagacaaugaauucagggnn

SEQ ID NO: 3547 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugaauucauugucucagnn

SEQ ID NO: 3548 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagacaaugaauucaggnn

SEQ ID NO: 3549 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauucauugucucagugann

SEQ ID NO: 3550 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucacugagacaaugaauucnn

SEQ ID NO: 3551 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauucauugucucagugaann

SEQ ID NO: 3552 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucacugagacaaugaauunn

SEQ ID NO: 3553 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauugucucagugaaggaann

SEQ ID NO: 3554 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccuucacugagacaaugnn

SEQ ID NO: 3555 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugucucagugaaggaagann

SEQ ID NO: 3556 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuccuucacugagacaann

SEQ ID NO: 3557 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucucagugaaggaagaann

SEQ ID NO: 3558 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuuccuucacugagacann

SEQ ID NO: 3559 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagugaaggaagaaccunn

SEQ ID NO: 3560 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agguucuuccuucacugagnn

SEQ ID NO: 3561 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagugaaggaagaaccugnn

SEQ ID NO: 3562 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagguucuuccuucacugann

SEQ ID NO: 3563 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagugaaggaagaaccugunn

SEQ ID NO: 3564 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagguucuuccuucacugnn

SEQ ID NO: 3565 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaagaaccuguagaagaunn

SEQ ID NO: 3566 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuucuacagguucuuccnn

SEQ ID NO: 3567 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaccuguagaagaugaccnn

SEQ ID NO: 3568 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggucaucuucuacagguucnn

SEQ ID NO: 3569 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accuguagaagaugaccucnn

SEQ ID NO: 3570 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggucaucuucuacaggunn

SEQ ID NO: 3571 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaaucugcuuucauccann

SEQ ID NO: 3572 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaugaaagcagauuugann

SEQ ID NO: 3573 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuugggaggacacuuuunn

SEQ ID NO: 3574 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaguguccucccaagaann

SEQ ID NO: 3575 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuuugacauccagcagunn

SEQ ID NO: 3576 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugcuggaugucaaaagann

SEQ ID NO: 3577 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagaaauauuacuauaaunn

SEQ ID NO: 3578 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuauaguaauauuucuuann

SEQ ID NO: 3579 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaaauauuacuauaauunn

SEQ ID NO: 3580 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuauaguaauauuucuunn

SEQ ID NO: 3581 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuucaaguaagaucaagann

SEQ ID NO: 3582 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuugaucuuacuugaagunn

SEQ ID NO: 3583 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucaaguaagaucaagaann

SEQ ID NO: 3584 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuugaucuuacuugaagnn

SEQ ID NO: 3585 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaugagugagcuggaacagnn

SEQ ID NO: 3586 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguuccagcucacucauunn

SEQ ID NO: 3587 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagugagcuggaacagcaann

SEQ ID NO: 3588 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcuguuccagcucacucnn

SEQ ID NO: 3589 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccuccagaacaucucccnn

SEQ ID NO: 3590 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggagauguucuggaggggnn

SEQ ID NO: 3591 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauucuggacaacuuggacnn

SEQ ID NO: 3592 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guccaaguuguccagaaugnn

SEQ ID NO: 3593 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaagccauuaaugaacuann

SEQ ID NO: 3594 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaguucauuaauggcuuccnn

SEQ ID NO: 3595 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcuuucauccagccacunn

SEQ ID NO: 3596 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguggcuggaugaaagcagnn

SEQ ID NO: 3597 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuacagugacuguggaunn

SEQ ID NO: 3598 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccacagucacuguaagcnn

SEQ ID NO: 3599 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guugcccuuuuccuugacunn

SEQ ID NO: 3600 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agucaaggaaaagggcaacnn

SEQ ID NO: 3601 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucaaaaagccaaaauagann

SEQ ID NO: 3602 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuauuuuggcuuuuugaann

SEQ ID NO: 3603 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguucagaucucauagaugnn

SEQ ID NO: 3604 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucuaugagaucugaacann

SEQ ID NO: 3605 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucagaucucauagaugann

SEQ ID NO: 3606 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaucuaugagaucugaacnn

SEQ ID NO: 3607 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacuacagcuuuuaagaunn

SEQ ID NO: 3608 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuuaaaagcuguaguucnn

SEQ ID NO: 3609 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaagauuguacuuuuaucunn

SEQ ID NO: 3610 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauaaaaguacaaucuuann

SEQ ID NO: 3611 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagauuguacuuuuaucuunn

SEQ ID NO: 3612 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagauaaaaguacaaucuunn

SEQ ID NO: 3613 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagcccgccuccgccgccnn

SEQ ID NO: 3614 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcggcggaggcgggcugcnn

SEQ ID NO: 3615 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuuuaucauuucucuucnn

SEQ ID NO: 3616 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagagaaaugauaaagaann

SEQ ID NO: 3617 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuuaucauuucucuuccnn

SEQ ID NO: 3618 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaagagaaaugauaaagann

SEQ ID NO: 3619 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucauuucucuucccccuunn

SEQ ID NO: 3620 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagggggaagagaaaugaunn

SEQ ID NO: 3621 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauuucucuucccccuuunn

SEQ ID NO: 3622 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagggggaagagaaaugann

SEQ ID NO: 3623 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucccccuuuuuggcaunn

SEQ ID NO: 3624 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augccaaaaagggggaagann

SEQ ID NO: 3625 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuggcuugccuccaguuunn

SEQ ID NO: 3626 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacuggaggcaagccaggnn

SEQ ID NO: 3627 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacaccugcugagggggcunn

SEQ ID NO: 3628 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcccccucagcagguguunn

SEQ ID NO: 3629 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaccugcugagggggcucnn

SEQ ID NO: 3630 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcccccucagcaggugunn

SEQ ID NO: 3631 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caccugcugagggggcucunn

SEQ ID NO: 3632 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagcccccucagcaggugnn

SEQ ID NO: 3633 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagggggcucuuucccucann

SEQ ID NO: 3634 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagggaaagagcccccucnn

SEQ ID NO: 3635 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucaagaaucuuuugugaann

SEQ ID NO: 3636 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucacaaaagauucuugaunn

SEQ ID NO: 3637 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccugcuaguguagcuucunn

SEQ ID NO: 3638 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaagcuacacuagcaggann

SEQ ID NO: 3639 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccggccggccaggcccugnn

SEQ ID NO: 3640 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagggccuggccggccgggnn

SEQ ID NO: 3641 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccaggcccugccgcucann

SEQ ID NO: 3642 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagcggcagggccuggccnn

SEQ ID NO: 3643 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggaggcagcgagcggggnn

SEQ ID NO: 3644 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccgctcgctgcctccggnn

SEQ ID NO: 3645 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggaggcagcgagcgggggnn

SEQ ID NO: 3646 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccccgctcgctgcctccgnn

SEQ ID NO: 3647 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggcagcgagcggggggnn

SEQ ID NO: 3648 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccccgctcgctgcctccnn

SEQ ID NO: 3649 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaggcgcugaggaggann

SEQ ID NO: 3650 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuccucagcgccuucucnn

SEQ ID NO: 3651 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaggcgcugaggaggaaann

SEQ ID NO: 3652 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuccuccucagcgccuucnn

SEQ ID NO: 3653 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaguagcagcucagacugnn

SEQ ID NO: 3654 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagucugagcugcuacucunn

SEQ ID NO: 3655 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaagaagagaaccaaaaann

SEQ ID NO: 3656 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
tttttggttctcttcttctnn

SEQ ID NO: 3657 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaagagaaccaaaaacunn

SEQ ID NO: 3658 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguuuuugguucucuucuunn

SEQ ID NO: 3659 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcuagaaaaucagcuuunn

SEQ ID NO: 3660 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagcugauuuucuagcaann

SEQ ID NO: 3661 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggauggaugcccugguugcnn

SEQ ID NO: 3662 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaaccagggcauccauccnn

SEQ ID NO: 3663 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggaagccaaggggaaugnn

SEQ ID NO: 3664 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuccccuuggcuuccgcnn

SEQ ID NO: 3665 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguggccgggucugcugann

SEQ ID NO: 3666 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagcagacccggccacugnn

SEQ ID NO: 3667 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaacuuggacccagucaunn

SEQ ID NO: 3668 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augacuggguccaaguugunn

SEQ ID NO: 3669 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagucauguucuucaaaugnn

SEQ ID NO: 3670 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauuugaagaacaugacugnn

SEQ ID NO: 3671 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggagcucccagaggucuann

SEQ ID NO: 3672 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagaccucugggagcuccunn

SEQ ID NO: 3673 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagccucccuuucucugucnn

SEQ ID NO: 3674 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacagagaaagggaggcugnn

SEQ ID NO: 3675 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaucagccaagcuggaagnn

SEQ ID NO: 3676 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuccagcuuggcugaugann

SEQ ID NO: 3677 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagccauuaaugaacuaaunn

SEQ ID NO: 3678 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuaguucauuaauggcuunn

SEQ ID NO: 3679 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacagagagccaagcuaaunn

SEQ ID NO: 3680 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuagcuuggcucucugucnn

SEQ ID NO: 3681 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagcaccucucagccccunn

SEQ ID NO: 3682 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggggcugagaggugcuucnn

SEQ ID NO: 3683 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaccucucagccccucagnn

SEQ ID NO: 3684 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaggggcugagaggugcnn

SEQ ID NO: 3685 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caccucucagccccucagann

SEQ ID NO: 3686 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugaggggcugagaggugnn

SEQ ID NO: 3687 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugaaggaagaaccuguann

SEQ ID NO: 3688 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacagguucuuccuucacunn

SEQ ID NO: 3689 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaccuguagaagaugaccunn

SEQ ID NO: 3690 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggucaucuucuacagguunn

SEQ ID NO: 3691 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcccggaggcagcgagcgnn

SEQ ID NO: 3692 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgctcgctgcctccgggctnn

SEQ ID NO: 3693 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacaacuuggacccagucann

SEQ ID NO: 3694 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugacuggguccaaguugucnn

SEQ ID NO: 3695 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagccucccuuucucugunn

SEQ ID NO: 3696 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acagagaaagggaggcuggnn

SEQ ID NO: 3697 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuuuccugcuaguguagnn

SEQ ID NO: 3698 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacacuagcaggaaaaaann

SEQ ID NO: 3699 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuuccugcuaguguagcnn

SEQ ID NO: 3700 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuacacuagcaggaaaaann

SEQ ID NO: 3701 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcauucuggacaacuugnn

SEQ ID NO: 3702 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaguuguccagaaugcccnn

SEQ ID NO: 3703 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuggaugcuuacagugacnn

SEQ ID NO: 3704 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucacuguaagcauccagunn

SEQ ID NO: 3705 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acucuucagauucagagucnn

SEQ ID NO: 3706 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacucugaaucugaagagunn

SEQ ID NO: 3707 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucugauauccuguugggcnn

SEQ ID NO: 3708 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccaacaggauaucagacnn

SEQ ID NO: 3709 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguggggacgucaucagccnn

SEQ ID NO: 3710 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugaugacguccccacunn

SEQ ID NO: 3711 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagaaccuguagaagaugnn

SEQ ID NO: 3712 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucuucuacagguucuucnn

SEQ ID NO: 3713 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacuggaugcuuacagugnn

SEQ ID NO: 3714 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacuguaagcauccaguagnn

SEQ ID NO: 3715 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guauugagacauauuacugnn

SEQ ID NO: 3716 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguaauaugucucaauacnn

SEQ ID NO: 3717 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuauaauugagaacuacagnn

SEQ ID NO: 3718 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguaguucucaauuauagnn

SEQ ID NO: 3719 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucugucggggcagcccgnn

SEQ ID NO: 3720 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgggcugccccgacagaagnn

SEQ ID NO: 3721 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacuuuuaucuuaaaagggnn

SEQ ID NO: 3722 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuuuuaagauaaaaguann

SEQ ID NO: 3723 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuucccccuuuuuggcann

SEQ ID NO: 3724 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccaaaaagggggaagagnn

SEQ ID NO: 3725 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccuuuuuggcauccuggnn

SEQ ID NO: 3726 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccaggaugccaaaaaggggnn

SEQ ID NO: 3727 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuuggcauccuggcuunn

SEQ ID NO: 3728 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagccaggaugccaaaaagnn

SEQ ID NO: 3729 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugauggaauuuuuuccunn

SEQ ID NO: 3730 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaaaaaauuccaucaagnn

SEQ ID NO: 3731 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugauggaauuuuuuccugnn

SEQ ID NO: 3732 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caggaaaaaauuccaucaann

SEQ ID NO: 3733 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugauggaauuuuuuccugcnn

SEQ ID NO: 3734 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaggaaaaaauuccaucann

SEQ ID NO: 3735 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagcagcucagacugccagnn

SEQ ID NO: 3736 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggcagucugagcugcuann

SEQ ID NO: 3737 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagugguagauuuagaagann

SEQ ID NO: 3738 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucuaaaucuaccacuunn

SEQ ID NO: 3739 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugguagauuuagaagaann

SEQ ID NO: 3740 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuucuaaaucuaccacunn

SEQ ID NO: 3741 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacucuucagauucagagunn

SEQ ID NO: 3742 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acucugaaucugaagagucnn

SEQ ID NO: 3743 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguugggcauucuggacann

SEQ ID NO: 3744 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguccagaaugcccaacagnn

SEQ ID NO: 3745 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggacaacuuggacccagunn

SEQ ID NO: 3746 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuggguccaaguuguccann

SEQ ID NO: 3747 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucuucaaaugcccuuccnn

SEQ ID NO: 3748 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaagggcauuugaagaacnn

SEQ ID NO: 3749 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuuucucugucagugggnn

SEQ ID NO: 3750 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccacugacagagaaagggnn

SEQ ID NO: 3751 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caguggggacgucaucagcnn

SEQ ID NO: 3752 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugaugacguccccacugnn

SEQ ID NO: 3753 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucagugaaggaagaaccnn

SEQ ID NO: 3754 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguucuuccuucacugagann

SEQ ID NO: 3755 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acacuuuugccaaugaacunn

SEQ ID NO: 3756 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aguucauuggcaaaagugunn

SEQ ID NO: 3757 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuugacauccagcagucnn

SEQ ID NO: 3758 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacugcuggaugucaaaagnn

SEQ ID NO: 3759 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagacaaaugucuugaagunn

SEQ ID NO: 3760 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuucaagacauuugucuann

SEQ ID NO: 3761 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauuuaugaaugguucuunn

SEQ ID NO: 3762 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaaccauucauaaauucnn

SEQ ID NO: 3763 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuuaugaaugguucuuunn

SEQ ID NO: 3764 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagaaccauucauaaauunn

SEQ ID NO: 3765 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucccccuuuuuggcauccnn

SEQ ID NO: 3766 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaugccaaaaagggggaann

SEQ ID NO: 3767 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccugccgcucauggugcnn

SEQ ID NO: 3768 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcaccaugagcggcagggcnn

SEQ ID NO: 3769 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucauggugccagcccagann

SEQ ID NO: 3770 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugggcuggcaccaugagnn

SEQ ID NO: 3771 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucgaaugagugagcuggann

SEQ ID NO: 3772 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccagcucacucauucgagnn

SEQ ID NO: 3773 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucgaaugagugagcuggaann

SEQ ID NO: 3774 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccagcucacucauucgann

SEQ ID NO: 3775 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augagugagcuggaacagcnn

SEQ ID NO: 3776 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuguuccagcucacucaunn

SEQ ID NO: 3777 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuguaguugagaaccaggnn

SEQ ID NO: 3778 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugguucucaacuacaagnn

SEQ ID NO: 3779 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaggaggcggaagccaagnn

SEQ ID NO: 3780 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cttggcttccgcctcctctnn

SEQ ID NO: 3781 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcccaguugucaccccucnn

SEQ ID NO: 3782 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggggugacaacugggccnn

SEQ ID NO: 3783 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuacccagaaggacccagnn

SEQ ID NO: 3784 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggguccuucuggguagann

SEQ ID NO: 3785 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacccagaaggacccagunn

SEQ ID NO: 3786 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuggguccuucuggguagnn

SEQ ID NO: 3787 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuggaagccauuaaugaann

SEQ ID NO: 3788 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucauuaauggcuuccagcnn

SEQ ID NO: 3789 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagagauacccucugagacnn

SEQ ID NO: 3790 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucucagaggguaucucuann

SEQ ID NO: 3791 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agagccaagcuaauguggunn

SEQ ID NO: 3792 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accacauuagcuuggcucunn

SEQ ID NO: 3793 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaggaagaaccuguagaagnn

SEQ ID NO: 3794 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucuacagguucuuccuunn

SEQ ID NO: 3795 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagaaccuguagaagaugann

SEQ ID NO: 3796 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaucuucuacagguucuunn

SEQ ID NO: 3797 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggagaaggcgcugaggagnn

SEQ ID NO: 3798 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccucagcgccuucuccunn

SEQ ID NO: 3799 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagaagagaaccaaaaacnn

SEQ ID NO: 3800 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gtttttggttctcttcttcnn

SEQ ID NO: 3801 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagccauuaaugaacuaann

SEQ ID NO: 3802 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaguucauuaauggcuucnn

SEQ ID NO: 3803 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagacagagagccaagcunn

SEQ ID NO: 3804 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuuggcucucugucucann

SEQ ID NO: 3805 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcaccucucagccccucnn

SEQ ID NO: 3806 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggggcugagaggugcuunn

SEQ ID NO: 3807 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacagcuuuuaagauuguann

SEQ ID NO: 3808 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacaaucuuaaaagcuguann

SEQ ID NO: 3809 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugucaguggggacgucnn

SEQ ID NO: 3810 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacguccccacugacagagnn

SEQ ID NO: 3811 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugccuccaguuuuaggunn

SEQ ID NO: 3812 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accuaaaacuggaggcaagnn

SEQ ID NO: 3813 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagacugccagagaucgaann

SEQ ID NO: 3814 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucgaucucuggcagucugnn

SEQ ID NO: 3815 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caacuuggacccagucaugnn

SEQ ID NO: 3816 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caugacuggguccaaguugnn

SEQ ID NO: 3817 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucugucaguggggacgunn

SEQ ID NO: 3818 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acguccccacugacagagann

SEQ ID NO: 3819 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggaagcaccucucagccnn

SEQ ID NO: 3820 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugagaggugcuuccucnn

SEQ ID NO: 3821 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuuuuccuugacuauuann

SEQ ID NO: 3822 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaauagucaaggaaaagggnn

SEQ ID NO: 3823 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauucaaaaagccaaaauann

SEQ ID NO: 3824 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuuuggcuuuuugaaugnn

SEQ ID NO: 3825 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaauauuacuauaauugnn

SEQ ID NO: 3826 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caauuauaguaauauuucunn

SEQ ID NO: 3827 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auauuacuauaauugagaann

SEQ ID NO: 3828 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucaauuauaguaauaunn

SEQ ID NO: 3829 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaaaauacuuauuauguann

SEQ ID NO: 3830 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacauaauaaguauuuuagnn

SEQ ID NO: 3831 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauacuuauuauguaagggnn

SEQ ID NO: 3832 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuuacauaauaaguauunn

SEQ ID NO: 3833 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcagcccgccuccgccnn

SEQ ID NO: 3834 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcggaggcgggcugccccnn

SEQ ID NO: 3835 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaacaccugcugagggggcnn

SEQ ID NO: 3836 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccccucagcagguguucnn

SEQ ID NO: 3837 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaucaagaaucuuuugugann

SEQ ID NO: 3838 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucacaaaagauucuugaucnn

SEQ ID NO: 3839 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauggaauuuuuuccugcunn

SEQ ID NO: 3840 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaggaaaaaauuccaucnn

SEQ ID NO: 3841 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggaauuuuuuccugcuann

SEQ ID NO: 3842 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagcaggaaaaaauuccaunn

SEQ ID NO: 3843 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaauuuuuuccugcuagugnn

SEQ ID NO: 3844 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacuagcaggaaaaaauucnn

SEQ ID NO: 3845 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagcuucugaaaggugcuunn

SEQ ID NO: 3846 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcaccuuucagaagcuann

SEQ ID NO: 3847 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuucugaaaggugcuuunn

SEQ ID NO: 3848 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagcaccuuucagaagcunn

SEQ ID NO: 3849 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccugccgcucauggugccnn

SEQ ID NO: 3850 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcaccaugagcggcagggnn

SEQ ID NO: 3851 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccugccgcucauggugccann

SEQ ID NO: 3852 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcaccaugagcggcaggnn

SEQ ID NO: 3853 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggugccagcccagagagnn

SEQ ID NO: 3854 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucucugggcuggcaccaunn

SEQ ID NO: 3855 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccagcccagagaggggcnn

SEQ ID NO: 3856 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccccucucugggcuggcann

SEQ ID NO: 3857 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgagcggggggcugccccann

SEQ ID NO: 3858 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggggcagccccccgcucgnn

SEQ ID NO: 3859 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccgaggagaaggcgcugnn

SEQ ID NO: 3860 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcgccuucuccucggggnn

SEQ ID NO: 3861 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgaggagaaggcgcugaggnn

SEQ ID NO: 3862 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucagcgccuucuccucgnn

SEQ ID NO: 3863 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaggcgcugaggaggaann

SEQ ID NO: 3864 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccuccucagcgccuucunn

SEQ ID NO: 3865 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaggaaacugaaaaacann

SEQ ID NO: 3866 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguuuuucaguuuccuccunn

SEQ ID NO: 3867 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcucagacugccagagaunn

SEQ ID NO: 3868 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucucuggcagucugagcunn

SEQ ID NO: 3869 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagacugccagagaucgann

SEQ ID NO: 3870 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucgaucucuggcagucugann

SEQ ID NO: 3871 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugagcuggaacagcaagunn

SEQ ID NO: 3872 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuugcuguuccagcucacnn

SEQ ID NO: 3873 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagagaaccaaaaacuuuunn

SEQ ID NO: 3874 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaguuuuugguucucuunn

SEQ ID NO: 3875 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaacuuuugcuagaaaaunn

SEQ ID NO: 3876 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuucuagcaaaaguuuunn

SEQ ID NO: 3877 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacuuuugcuagaaaaucnn

SEQ ID NO: 3878 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuuucuagcaaaaguuunn

SEQ ID NO: 3879 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuuuugcuagaaaaucann

SEQ ID NO: 3880 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugauuuucuagcaaaaguunn

SEQ ID NO: 3881 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagaaaaucagcuuuuacgnn

SEQ ID NO: 3882 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cguaaaagcugauuuucuann

SEQ ID NO: 3883 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguaguugagaaccaggagnn

SEQ ID NO: 3884 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccugguucucaacuacann

SEQ ID NO: 3885 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaguugagaaccaggagunn

SEQ ID NO: 3886 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuccugguucucaacuacnn

SEQ ID NO: 3887 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaggcggaagccaagggnn

SEQ ID NO: 3888 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccttggcttccgcctcctnn

SEQ ID NO: 3889 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggcggaagccaaggggann

SEQ ID NO: 3890 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
tccccttggcttccgcctcnn

SEQ ID NO: 3891 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcggaagccaaggggaann

SEQ ID NO: 3892 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ttccccttggcttccgcctnn

SEQ ID NO: 3893 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugaggccaguggccgggunn

SEQ ID NO: 3894 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccggccacuggccucacnn

SEQ ID NO: 3895 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggucugcugaguccgcagnn

SEQ ID NO: 3896 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugcggacucagcagacccnn

SEQ ID NO: 3897 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcaggcccaguugucaccnn

SEQ ID NO: 3898 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggugacaacugggccugcann

SEQ ID NO: 3899 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuccagaacaucuccccnn

SEQ ID NO: 3900 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggagauguucuggagggnn

SEQ ID NO: 3901 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccagaacaucuccccaunn

SEQ ID NO: 3902 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggggagauguucuggagnn

SEQ ID NO: 3903 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auccuguugggcauucuggnn

SEQ ID NO: 3904 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagaaugcccaacaggaunn

SEQ ID NO: 3905 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuuggacccagucaugunn

SEQ ID NO: 3906 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaugacuggguccaaguunn

SEQ ID NO: 3907 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccagucauguucuucaaann

SEQ ID NO: 3908 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuugaagaacaugacugggnn

SEQ ID NO: 3909 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagucauguucuucaaaunn

SEQ ID NO: 3910 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuugaagaacaugacuggnn

SEQ ID NO: 3911 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuucaaaugcccuucccnn

SEQ ID NO: 3912 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggaagggcauuugaagaann

SEQ ID NO: 3913 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuucaaaugcccuuccccnn

SEQ ID NO: 3914 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggaagggcauuugaagann

SEQ ID NO: 3915 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggaggagcucccagaggnn

SEQ ID NO: 3916 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucugggagcuccuccagnn

SEQ ID NO: 3917 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucuacccagaaggacccann

SEQ ID NO: 3918 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggguccuucuggguagacnn

SEQ ID NO: 3919 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuuaccagccucccuuunn

SEQ ID NO: 3920 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagggaggcugguaaggann

SEQ ID NO: 3921 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaccagccucccuuucucnn

SEQ ID NO: 3922 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaagggaggcugguaann

SEQ ID NO: 3923 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucccuuucucugucaguggnn

SEQ ID NO: 3924 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacugacagagaaagggann

SEQ ID NO: 3925 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caucagccaagcuggaagcnn

SEQ ID NO: 3926 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuccagcuuggcugaugnn

SEQ ID NO: 3927 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacccucugagacagagagnn

SEQ ID NO: 3928 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucucugucucagaggguann

SEQ ID NO: 3929 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acccucugagacagagagcnn

SEQ ID NO: 3930 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcucucugucucagagggunn

SEQ ID NO: 3931 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagacagagagccaagcuann

SEQ ID NO: 3932 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagcuuggcucucugucucnn

SEQ ID NO: 3933 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agacagagagccaagcuaann

SEQ ID NO: 3934 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuagcuuggcucucugucunn

SEQ ID NO: 3935 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auugucucagugaaggaagnn

SEQ ID NO: 3936 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuccuucacugagacaaunn

SEQ ID NO: 3937 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucucagugaaggaagaacnn

SEQ ID NO: 3938 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucuuccuucacugagacnn

SEQ ID NO: 3939 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacugccuggaggauagcann

SEQ ID NO: 3940 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuauccuccaggcagugnn

SEQ ID NO: 3941 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aauuuuuuccugcuagugunn

SEQ ID NO: 3942 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acacuagcaggaaaaaauunn

SEQ ID NO: 3943 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggcagcgagcggggggcunn

SEQ ID NO: 3944 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccccccgcucgcugccunn

SEQ ID NO: 3945 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugccccaggcgcgcaann

SEQ ID NO: 3946 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcgcgccuggggcagccnn

SEQ ID NO: 3947 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaggaggaaacugaaaaann

SEQ ID NO: 3948 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuucaguuuccuccucann

SEQ ID NO: 3949 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaugugguagugaaaaucnn

SEQ ID NO: 3950 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuuucacuaccacauuann

SEQ ID NO: 3951 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguggugguggcagccgcnn

SEQ ID NO: 3952 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggcugccaccaccaccann

SEQ ID NO: 3953 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguaucucaaaucugcuuunn

SEQ ID NO: 3954 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaagcagauuugagauaccnn

SEQ ID NO: 3955 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucaaaucugcuuucaucnn

SEQ ID NO: 3956 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaugaaagcagauuugagann

SEQ ID NO: 3957 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucaaaucugcuuucauccnn

SEQ ID NO: 3958 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaugaaagcagauuugagnn

SEQ ID NO: 3959 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccugccuacuggaugcuunn

SEQ ID NO: 3960 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagcauccaguaggcaggann

SEQ ID NO: 3961 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaugcuuacagugacugugnn

SEQ ID NO: 3962 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacagucacuguaagcaucnn

SEQ ID NO: 3963 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucagugacauguccucucnn

SEQ ID NO: 3964 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaggacaugucacugaann

SEQ ID NO: 3965 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauucuugggaggacacuunn

SEQ ID NO: 3966 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaguguccucccaagaaugnn

SEQ ID NO: 3967 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucuugggaggacacuuunn

SEQ ID NO: 3968 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaguguccucccaagaaunn

SEQ ID NO: 3969 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacacuuuugccaaugaacnn

SEQ ID NO: 3970 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucauuggcaaaagugucnn

SEQ ID NO: 3971 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugcccuuuuccuugacuann

SEQ ID NO: 3972 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagucaaggaaaagggcaann

SEQ ID NO: 3973 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucauucaaaaagccaaann

SEQ ID NO: 3974 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuggcuuuuugaaugaagnn

SEQ ID NO: 3975 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucauucaaaaagccaaaann

SEQ ID NO: 3976 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuggcuuuuugaaugaann

SEQ ID NO: 3977 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucaaaaagccaaaauagnn

SEQ ID NO: 3978 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuauuuuggcuuuuugaaunn

SEQ ID NO: 3979 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaaaagccaaaauagagnn

SEQ ID NO: 3980 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuauuuuggcuuuuugann

SEQ ID NO: 3981 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaagccaaaauagagagnn

SEQ ID NO: 3982 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucucuauuuuggcuuuuunn

SEQ ID NO: 3983 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugucuuuugacauccagcann

SEQ ID NO: 3984 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuggaugucaaaagacann

SEQ ID NO: 3985 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaauauuacuauaauugann

SEQ ID NO: 3986 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaauuauaguaauauuucnn

SEQ ID NO: 3987 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauuacuauaauugagaacnn

SEQ ID NO: 3988 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucucaauuauaguaauann

SEQ ID NO: 3989 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaacuacagcuuuuaagnn

SEQ ID NO: 3990 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuaaaagcuguaguucucnn

SEQ ID NO: 3991 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuguacuuuuaucuuaann

SEQ ID NO: 3992 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaagauaaaaguacaaucnn

SEQ ID NO: 3993 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugucggggcagcccgccnn

SEQ ID NO: 3994 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcgggcugccccgacagann

SEQ ID NO: 3995 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguacuuuuaucuuaaaagnn

SEQ ID NO: 3996 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuuaagauaaaaguacann

SEQ ID NO: 3997 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcagcccgccuccgccgnn

SEQ ID NO: 3998 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggcggaggcgggcugcccnn

SEQ ID NO: 3999 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcagcccgccuccgccgcnn

SEQ ID NO: 4000 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggcggaggcgggcugccnn

SEQ ID NO: 4001 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuaugaaugguucuuuann

SEQ ID NO: 4002 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaagaaccauucauaaaunn

SEQ ID NO: 4003 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaugaaugguucuuuaunn

SEQ ID NO: 4004 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auaaagaaccauucauaaann

SEQ ID NO: 4005 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuaucauuucucuucccnn

SEQ ID NO: 4006 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggaagagaaaugauaaagnn

SEQ ID NO: 4007 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagcccgccuccgccgccgnn

SEQ ID NO: 4008 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggcggcggaggcgggcugnn

SEQ ID NO: 4009 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuucucuucccccuuuuunn

SEQ ID NO: 4010 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaagggggaagagaaaunn

SEQ ID NO: 4011 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucccccuuuuuggcauccunn

SEQ ID NO: 4012 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaugccaaaaagggggann

SEQ ID NO: 4013 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccuuuuuggcauccuggcnn

SEQ ID NO: 4014 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaggaugccaaaaagggnn

SEQ ID NO: 4015 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuuuuggcauccuggcunn

SEQ ID NO: 4016 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccaggaugccaaaaaggnn

SEQ ID NO: 4017 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcccgccuccgccgccggann

SEQ ID NO: 4018 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccggcggcggaggcgggcnn

SEQ ID NO: 4019 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcauccuggcuugccucnn

SEQ ID NO: 4020 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggcaagccaggaugccann

SEQ ID NO: 4021 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuggcuugccuccaguunn

SEQ ID NO: 4022 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuggaggcaagccaggann

SEQ ID NO: 4023 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccgccuccgccgccggagnn

SEQ ID NO: 4024 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccggcggcggaggcgggnn

SEQ ID NO: 4025 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgccuccgccgccggagcnn

SEQ ID NO: 4026 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuccggcggcggaggcggnn

SEQ ID NO: 4027 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccuccgccgccggagccnn

SEQ ID NO: 4028 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuccggcggcggaggcgnn

SEQ ID NO: 4029 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccgccgccggagccccggnn

SEQ ID NO: 4030 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggggcuccggcggcggann

SEQ ID NO: 4031 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccgccggagccccggccnn

SEQ ID NO: 4032 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccggggctccggcggcgnn

SEQ ID NO: 4033 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucaaguaagaucaagaaunn

SEQ ID NO: 4034 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucuugaucuuacuugaann

SEQ ID NO: 4035 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccgccggagccccggccgnn

SEQ ID NO: 4036 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggccggggctccggcggcnn

SEQ ID NO: 4037 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccggagccccggccggcnn

SEQ ID NO: 4038 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccggccggggctccggcgnn

SEQ ID NO: 4039 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccggagccccggccggccnn

SEQ ID NO: 4040 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccggccggggctccggcnn

SEQ ID NO: 4041 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggagccccggccggccann

SEQ ID NO: 4042 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
tggccggccggggctccggnn

SEQ ID NO: 4043 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uauguaaaugcuugauggann

SEQ ID NO: 4044 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccaucaagcauuuacauann

SEQ ID NO: 4045 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaugcuugauggaauuunn

SEQ ID NO: 4046 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaauuccaucaagcauuuann

SEQ ID NO: 4047 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggagccccggccggccagnn

SEQ ID NO: 4048 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ctggccggccggggctccgnn

SEQ ID NO: 4049 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggagccccggccggccaggnn

SEQ ID NO: 4050 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cctggccggccggggctccnn

SEQ ID NO: 4051 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagccccggccggccaggcnn

SEQ ID NO: 4052 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcctggccggccggggctcnn

SEQ ID NO: 4053 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccccggccggccaggcccnn

SEQ ID NO: 4054 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcctggccggccggggcnn

SEQ ID NO: 4055 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccauuuauuuaaaacuacnn

SEQ ID NO: 4056 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guaguuuuaaauaaauggann

SEQ ID NO: 4057 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccggccggccaggcccunn

SEQ ID NO: 4058 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggccuggccggccggggnn

SEQ ID NO: 4059 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggccggccaggcccugcnn

SEQ ID NO: 4060 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcagggccuggccggccggnn

SEQ ID NO: 4061 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggccggccaggcccugccnn

SEQ ID NO: 4062 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcagggccuggccggccgnn

SEQ ID NO: 4063 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggccggccaggcccugccgnn

SEQ ID NO: 4064 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggcagggccuggccggccnn

SEQ ID NO: 4065 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccggccaggcccugccgcnn

SEQ ID NO: 4066 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggcagggccuggccggcnn

SEQ ID NO: 4067 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggccaggcccugccgcunn

SEQ ID NO: 4068 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcggcagggccuggccggnn

SEQ ID NO: 4069 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggccaggcccugccgcucnn

SEQ ID NO: 4070 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcggcagggccuggccgnn

SEQ ID NO: 4071 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucauggugccagcccagagnn

SEQ ID NO: 4072 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugggcuggcaccaugann

SEQ ID NO: 4073 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cauggugccagcccagagann

SEQ ID NO: 4074 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucucugggcuggcaccaugnn

SEQ ID NO: 4075 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggugccagcccagagaggnn

SEQ ID NO: 4076 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucucugggcuggcaccann

SEQ ID NO: 4077 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggugccagcccagagagggnn

SEQ ID NO: 4078 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccucucugggcuggcaccnn

SEQ ID NO: 4079 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugccagcccagagaggggnn

SEQ ID NO: 4080 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccccucucugggcuggcacnn

SEQ ID NO: 4081 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcggggggcugccccagnn

SEQ ID NO: 4082 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggggcagccccccgcucnn

SEQ ID NO: 4083 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcggggggcugccccaggnn

SEQ ID NO: 4084 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuggggcagccccccgcunn

SEQ ID NO: 4085 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcggggggcugccccaggcnn

SEQ ID NO: 4086 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuggggcagccccccgcnn

SEQ ID NO: 4087 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggggggcugccccaggcgnn

SEQ ID NO: 4088 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccuggggcagccccccgnn

SEQ ID NO: 4089 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcugccccaggcgcgcann

SEQ ID NO: 4090 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcgcgccuggggcagcccnn

SEQ ID NO: 4091 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccccaggcgcgcaagcgnn

SEQ ID NO: 4092 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgcuugcgcgccuggggcann

SEQ ID NO: 4093 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagccccgaggagaaggcnn

SEQ ID NO: 4094 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuucuccucggggcucann

SEQ ID NO: 4095 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccccgaggagaaggcgcunn

SEQ ID NO: 4096 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcgccuucuccucggggcnn

SEQ ID NO: 4097 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggagaaggcgcugaggaggnn

SEQ ID NO: 4098 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuccucagcgccuucuccnn

SEQ ID NO: 4099 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaggcgcugaggaggaaacnn

SEQ ID NO: 4100 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuuccuccucagcgccuunn

SEQ ID NO: 4101 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcgcugaggaggaaacugann

SEQ ID NO: 4102 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaguuuccuccucagcgcnn

SEQ ID NO: 4103 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgcugaggaggaaacugaann

SEQ ID NO: 4104 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucaguuuccuccucagcgnn

SEQ ID NO: 4105 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugaggaggaaacugaaann

SEQ ID NO: 4106 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucaguuuccuccucagcnn

SEQ ID NO: 4107 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaggaggaaacugaaaann

SEQ ID NO: 4108 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuucaguuuccuccucagnn

SEQ ID NO: 4109 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggaggaaacugaaaaacnn

SEQ ID NO: 4110 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuuuucaguuuccuccucnn

SEQ ID NO: 4111 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggaaacugaaaaacagnn

SEQ ID NO: 4112 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuguuuuucaguuuccuccnn

SEQ ID NO: 4113 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggaaacugaaaaacagann

SEQ ID NO: 4114 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuguuuuucaguuuccucnn

SEQ ID NO: 4115 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaacugaaaaacagaguagnn

SEQ ID NO: 4116 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacucuguuuuucaguuunn

SEQ ID NO: 4117 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgaaugagugagcuggaacnn

SEQ ID NO: 4118 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuccagcucacucauucgnn

SEQ ID NO: 4119 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaugagugagcuggaacann

SEQ ID NO: 4120 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uguuccagcucacucauucnn

SEQ ID NO: 4121 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agugagcuggaacagcaagnn

SEQ ID NO: 4122 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuugcuguuccagcucacunn

SEQ ID NO: 4123 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugagcuggaacagcaagugnn

SEQ ID NO: 4124 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacuugcuguuccagcucann

SEQ ID NO: 4125 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcuggaacagcaaguggnn

SEQ ID NO: 4126 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccacuugcuguuccagcucnn

SEQ ID NO: 4127 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuggaacagcaaguggunn

SEQ ID NO: 4128 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accacuugcuguuccagcunn

SEQ ID NO: 4129 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagauuuagaagaagagaann

SEQ ID NO: 4130 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucuucuucuaaaucuann

SEQ ID NO: 4131 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agauuuagaagaagagaacnn

SEQ ID NO: 4132 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guucucuucuucuaaaucunn

SEQ ID NO: 4133 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuuagaagaagagaaccann

SEQ ID NO: 4134 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugguucucuucuucuaaaunn

SEQ ID NO: 4135 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuagaagaagagaaccaann

SEQ ID NO: 4136 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugguucucuucuucuaaann

SEQ ID NO: 4137 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uagaagaagagaaccaaaann

SEQ ID NO: 4138 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuugguucucuucuucuann

SEQ ID NO: 4139 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaagagaaccaaaaacuuunn

SEQ ID NO: 4140 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaguuuuugguucucuucnn

SEQ ID NO: 4141 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuugcuagaaaaucagcnn

SEQ ID NO: 4142 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugauuuucuagcaaaagnn

SEQ ID NO: 4143 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugcuagaaaaucagcuuuunn

SEQ ID NO: 4144 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaagcugauuuucuagcann

SEQ ID NO: 4145 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuuacgagagaaaacucann

SEQ ID NO: 4146 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaguuuucucucguaaaann

SEQ ID NO: 4147 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggggauggaugcccuggunn

SEQ ID NO: 4148 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accagggcauccauccccann

SEQ ID NO: 4149 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggaggcggaagccaaggnn

SEQ ID NO: 4150 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccttggcttccgcctcctcnn

SEQ ID NO: 4151 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcggaagccaaggggaaunn

SEQ ID NO: 4152 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auuccccuuggcuuccgccnn

SEQ ID NO: 4153 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugcaggcccaguugucacnn

SEQ ID NO: 4154 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugacaacugggccugcacnn

SEQ ID NO: 4155 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuccagaacaucuccccann

SEQ ID NO: 4156 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggggagauguucuggaggnn

SEQ ID NO: 4157 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucuccccauggauucuggnn

SEQ ID NO: 4158 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagaauccauggggagaunn

SEQ ID NO: 4159 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auugacucuucagauucagnn

SEQ ID NO: 4160 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaaucugaagagucaaunn

SEQ ID NO: 4161 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucagauucagagucugaunn

SEQ ID NO: 4162 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucagacucugaaucugaann

SEQ ID NO: 4163 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagauucagagucugauann

SEQ ID NO: 4164 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaucagacucugaaucugann

SEQ ID NO: 4165 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucuggacaacuuggaccnn

SEQ ID NO: 4166 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguccaaguuguccagaaunn

SEQ ID NO: 4167 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucuggacaacuuggacccnn

SEQ ID NO: 4168 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggguccaaguuguccagaann

SEQ ID NO: 4169 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggacaacuuggacccagnn

SEQ ID NO: 4170 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuggguccaaguuguccagnn

SEQ ID NO: 4171 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gacccagucauguucuucann

SEQ ID NO: 4172 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaagaacaugacugggucnn

SEQ ID NO: 4173 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auguucuucaaaugcccuunn

SEQ ID NO: 4174 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagggcauuugaagaacaunn

SEQ ID NO: 4175 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccagccuggaggagcunn

SEQ ID NO: 4176 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuccuccaggcuggcagnn

SEQ ID NO: 4177 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagccuggaggagcucccann

SEQ ID NO: 4178 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugggagcuccuccaggcugnn

SEQ ID NO: 4179 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccuggaggagcucccagnn

SEQ ID NO: 4180 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugggagcuccuccaggcunn

SEQ ID NO: 4181 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuggaggagcucccagann

SEQ ID NO: 4182 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugggagcuccuccaggcnn

SEQ ID NO: 4183 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuggaggagcucccagagnn

SEQ ID NO: 4184 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugggagcuccuccaggnn

SEQ ID NO: 4185 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggaggagcucccagaggunn

SEQ ID NO: 4186 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accucugggagcuccuccann

SEQ ID NO: 4187 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaggagcucccagaggucnn

SEQ ID NO: 4188 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaccucugggagcuccuccnn

SEQ ID NO: 4189 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaggucuacccagaaggnn

SEQ ID NO: 4190 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuucuggguagaccucugnn

SEQ ID NO: 4191 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacccagaaggacccaguunn

SEQ ID NO: 4192 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aacuggguccuucuggguann

SEQ ID NO: 4193 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guuccuuaccagccucccunn

SEQ ID NO: 4194 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agggaggcugguaaggaacnn

SEQ ID NO: 4195 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuccuuaccagccucccuunn

SEQ ID NO: 4196 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aagggaggcugguaaggaann

SEQ ID NO: 4197 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuaccagccucccuuucnn

SEQ ID NO: 4198 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaagggaggcugguaaggnn

SEQ ID NO: 4199 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
accagccucccuuucucugnn

SEQ ID NO: 4200 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagagaaagggaggcuggunn

SEQ ID NO: 4201 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccucccuuucucugucagnn

SEQ ID NO: 4202 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugacagagaaagggaggcnn

SEQ ID NO: 4203 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuucucugucaguggggann

SEQ ID NO: 4204 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccccacugacagagaaagnn

SEQ ID NO: 4205 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuucucugucaguggggacnn

SEQ ID NO: 4206 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guccccacugacagagaaann

SEQ ID NO: 4207 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagccaagcuggaagccaunn

SEQ ID NO: 4208 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auggcuuccagcuuggcugnn

SEQ ID NO: 4209 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcuaugguggugguggcnn

SEQ ID NO: 4210 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccaccaccaccauagcucnn

SEQ ID NO: 4211 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcuaugguggugguggcann

SEQ ID NO: 4212 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccaccaccaccauagcunn

SEQ ID NO: 4213 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuuagagauacccucugann

SEQ ID NO: 4214 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagaggguaucucuaagann

SEQ ID NO: 4215 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauacccucugagacagagnn

SEQ ID NO: 4216 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugucucagaggguaucnn

SEQ ID NO: 4217 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuaugguggugguggcagcnn

SEQ ID NO: 4218 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcugccaccaccaccauagnn

SEQ ID NO: 4219 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccucugagacagagagccnn

SEQ ID NO: 4220 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcucucugucucagagggnn

SEQ ID NO: 4221 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucugagacagagagccann

SEQ ID NO: 4222 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uggcucucugucucagaggnn

SEQ ID NO: 4223 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucugagacagagagccaann

SEQ ID NO: 4224 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuggcucucugucucagagnn

SEQ ID NO: 4225 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugagacagagagccaagnn

SEQ ID NO: 4226 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuggcucucugucucagann

SEQ ID NO: 4227 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagacagagagccaagcnn

SEQ ID NO: 4228 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuuggcucucugucucagnn

SEQ ID NO: 4229 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
augguggugguggcagccgnn

SEQ ID NO: 4230 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggcugccaccaccaccaunn

SEQ ID NO: 4231 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaaaucgaggaagcaccunn

SEQ ID NO: 4232 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggugcuuccucgauuuucnn

SEQ ID NO: 4233 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaucgaggaagcaccucnn

SEQ ID NO: 4234 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggugcuuccucgauuuunn

SEQ ID NO: 4235 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcaccucucagccccucann

SEQ ID NO: 4236 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaggggcugagaggugcunn

SEQ ID NO: 4237 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaugaucacccugaaunn

SEQ ID NO: 4238 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucagggugaucauucucnn

SEQ ID NO: 4239 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugaauucauugucucagunn

SEQ ID NO: 4240 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugagacaaugaauucagnn

SEQ ID NO: 4241 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugaauucauugucucagugnn

SEQ ID NO: 4242 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacugagacaaugaauucann

SEQ ID NO: 4243 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
auucauugucucagugaagnn

SEQ ID NO: 4244 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuucacugagacaaugaaunn

SEQ ID NO: 4245 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gugaaggaagaaccuguagnn

SEQ ID NO: 4246 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuacagguucuuccuucacnn

SEQ ID NO: 4247 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaccuguagaagaugacnn

SEQ ID NO: 4248 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucaucuucuacagguucunn

SEQ ID NO: 4249 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgccggagccccggccggnn

SEQ ID NO: 4250 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggccggggctccggcggnn

SEQ ID NO: 4251 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagccccgaggagaaggcgnn

SEQ ID NO: 4252 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cgccttctcctcggggctcnn

SEQ ID NO: 4253 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucaaaugcccuuccccagann

SEQ ID NO: 4254 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucuggggaagggcauuugann

SEQ ID NO: 4255 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaggagcucccagaggucunn

SEQ ID NO: 4256 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaccucugggagcuccucnn

SEQ ID NO: 4257 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucccuuucucugucagugnn

SEQ ID NO: 4258 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cacugacagagaaagggagnn

SEQ ID NO: 4259 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aucagccaagcuggaagccnn

SEQ ID NO: 4260 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcuuccagcuuggcugaunn

SEQ ID NO: 4261 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgaggagaaggcgcugagnn

SEQ ID NO: 4262 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucagcgccuucuccucggnn

SEQ ID NO: 4263 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuugcuagaaaaucagcunn

SEQ ID NO: 4264 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcugauuuucuagcaaaann

SEQ ID NO: 4265 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agcccgccuccgccgccggnn

SEQ ID NO: 4266 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccggcggcggaggcgggcunn

SEQ ID NO: 4267 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuccgccgccggagccccgnn

SEQ ID NO: 4268 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cggggcuccggcggcggagnn

SEQ ID NO: 4269 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccgccgccggagccccggcnn

SEQ ID NO: 4270 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccggggctccggcggcggnn

SEQ ID NO: 4271 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agccccggccggccaggccnn

SEQ ID NO: 4272 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcctggccggccggggctnn

SEQ ID NO: 4273 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cccgaggagaaggcgcugann

SEQ ID NO: 4274 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucagcgccuucuccucgggnn

SEQ ID NO: 4275 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aggaaacugaaaaacagagnn

SEQ ID NO: 4276 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cucuguuuuucaguuuccunn

SEQ ID NO: 4277 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccuguugggcauucuggann

SEQ ID NO: 4278 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uccagaaugcccaacaggann

SEQ ID NO: 4279 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccucccuuucucugucagunn

SEQ ID NO: 4280 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acugacagagaaagggaggnn

SEQ ID NO: 4281 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuaugguggugguggcagnn

SEQ ID NO: 4282 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugccaccaccaccauagcnn

SEQ ID NO: 4283 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guacuuuuaucuuaaaaggnn

SEQ ID NO: 4284 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuuuuaagauaaaaguacnn

SEQ ID NO: 4285 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuaugaaugguucuuuaucnn

SEQ ID NO: 4286 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauaaagaaccauucauaann

SEQ ID NO: 4287 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uuuaucauuucucuuccccnn

SEQ ID NO: 4288 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggaagagaaaugauaaann

SEQ ID NO: 4289 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccuccgccgccggagcccnn

SEQ ID NO: 4290 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggcuccggcggcggaggcnn

SEQ ID NO: 4291 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuccgccgccggagccccnn

SEQ ID NO: 4292 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggggcuccggcggcggaggnn

SEQ ID NO: 4293 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cugagccccgaggagaaggnn

SEQ ID NO: 4294 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuucuccucggggcucagnn

SEQ ID NO: 4295 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggaaacugaaaaacagagunn

SEQ ID NO: 4296 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acucuguuuuucaguuuccnn

SEQ ID NO: 4297 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gaaacugaaaaacagaguann

SEQ ID NO: 4298 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uacucuguuuuucaguuucnn

SEQ ID NO: 4299 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gauuuagaagaagagaaccnn

SEQ ID NO: 4300 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gguucucuucuucuaaaucnn

SEQ ID NO: 4301 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gcuagaaaaucagcuuuuann

SEQ ID NO: 4302 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaaaagcugauuuucuagcnn

SEQ ID NO: 4303 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uugacucuucagauucagann

SEQ ID NO: 4304 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ucugaaucugaagagucaann

SEQ ID NO: 4305 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuguugggcauucuggacnn

SEQ ID NO: 4306 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
guccagaaugcccaacaggnn

SEQ ID NO: 4307 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ugccagccuggaggagcucnn

SEQ ID NO: 4308 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagcuccuccaggcuggcann

SEQ ID NO: 4309 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gccagccuggaggagcuccnn

SEQ ID NO: 4310 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggagcuccuccaggcuggcnn

SEQ ID NO: 4311 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccagccuggaggagcucccnn

SEQ ID NO: 4312 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gggagcuccuccaggcuggnn

SEQ ID NO: 4313 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucucugucaguggggacgnn

SEQ ID NO: 4314 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cguccccacugacagagaann

SEQ ID NO: 4315 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gucuuagagauacccucugnn

SEQ ID NO: 4316 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cagaggguaucucuaagacnn

SEQ ID NO: 4317 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uaugguggugguggcagccnn

SEQ ID NO: 4318 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ggcugccaccaccaccauann

SEQ ID NO: 4319 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
uucauugucucagugaaggnn

SEQ ID NO: 4320 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
ccuucacugagacaaugaann

SEQ ID NO: 4321 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
agaaaacucacggccuugunn

SEQ ID NO: 4322 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acaaggccgugaguuuucunn

SEQ ID NO: 4323 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
gagaaaacucacggccuugnn

SEQ ID NO: 4324 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
caaggccgugaguuuucucnn

SEQ ID NO: 4325 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
cuuuugccaaugaacuuuunn

SEQ ID NO: 4326 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaaguucauuggcaaaagnn

SEQ ID NO: 4327 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
acuuuugccaaugaacuuunn

SEQ ID NO: 4328 - DNA, 21 bp, Artificial Sequence
  Description of Combined DNA/RNA Molecule: Synthetic oligonucleotide
  Description of Artificial Sequence: Synthetic oligonucleotide
  modified_base (20)..(21): a, c, g, t or u
aaaguucauuggcaaaagunn

SEQ ID NO: 4329 - DNA, 40 bp, Artificial Sequence
  Description of Artificial Sequence: Synthetic oligonucleotide
aagaggatcaccctgaattcattgtctcagtgaagaaaga

SEQ ID NO: 4330 - DNA, 40 bp, Artificial Sequence; identical to SEQ ID NO: 4329
  Description of Artificial Sequence: Synthetic oligonucleotide

SEQ ID NO: 4331 - DNA, 1836 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcaaaaaaaaaaaaaaaaa

SEQ ID NO: 4332 - DNA, 1817 bp, Mus musculus
gcggcgctggcgtagacgtttcctggctatggtggtggtggcagcggcgccgagcgcggccacggcggcccccaaagtgctactcttatctggccagcccgcctccggcggccgggcgctgccgctcatggtacccggtccgcgggcagcagggtcggaggcgagcgggacaccgcaggctcgcaagcggcagcggctcacgcacctgagcccggaggagaaagcgctgcggaggaaactgaaaaacagagtagcagcgcagactgctcgagatagaaagaaagcccggatgagcgagctggagcagcaagtggtggatttggaagaagagaaccacaaactccagctagaaaatcagcttttacgggagaaaactcacggccttgtggttgagaaccaggagttaagaacacgcttgggaatggacacgctggatcctgacgaggttccagaggtggaggccaaggggagtggagtaaggctggtggccgggtctgctgagtccgcagcactcagactatgtgcacctctgcagcaggtgcaggcccagttgtcacctccccagaacatcttcccatggactctgacactgttgcctcttcagattctgagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaaaaaaaaaaaaaaaaaaa

SEQ ID NO: 4333 - DNA, 1851 bp, Rattus norvegicus
tggctatggtggtggtggcagcggcgccgagcgcggcctcggcggcccccaaagtgctactcctatctggtcagcccgcctccggcggccgagcgctgccgctcatggttccgggcccgcgagccgcagggtcggaggcgagcgggacaccgcaggctcgcaagcggcagcgcctcacgcacctgagcccggaggagaaagcgctgcggaggaaactgaaaaacagagtagcagcacagactgcgcgagatagaaagaaagcccggatgagcgagctggagcagcaagtggtggatttggaagaagagaaccagaaactccagctagaaaatcagcttttacgagagaaaactcatgggcttgtgattgagaaccaggagttaaggacacgcttggggatgaatgccctggttactgaagaggtctcagaggcagagtccaaggggaatggagtaaggctggtggccgggtctgctgagtccgcagcactcagactacgtgcgcctctgcagcaggtgcaggcccagttgtcacctccccagaacatcttcccatggattctgacgctgttgcctcttcagattctgagtctgatatccttttgggcattctggacaagttggaccctgtcatgtttttcaaatgtccttccccagagtctgctaatctggaggaactcccagaggtctacccagaaggacctagttccttaccagcctccctttctctgtcagtggggacctcatcagccaagctggaagccattaatgaactcattcgttttgaccatgtatacaccaagcctctagtcttagagatcccctctgagacagagagccaaactaatgtggtagtgaaaattgaggaagcacctctaagctcttcagaagaggatcaccctgaattcattgtctcagtgaagaaagaacctttggatgatgacttcattcccgagctgggcatctcaaacctgctttcatccagccattgtctgagaccaccttcctgcctgctggatgctcacagtgactgtggatatgagggctccccttctcccttcagcgacatgtcttctccacttggtacagaccactcctgggaggacacttttgccaacgaacttttcccccagctgattagtgtctaaagccacccaccactgggctccttccctgatcatcacactgcctagaggatagcataggcctgtctgcttcactaaaagccaaagtagaggctatctggccttataagaattcctctaaagtatttcaaacctcttagatgacttccaagtattgtcttttgacactcagctgtctgaggtcttcaaaggtattccaatactacagcttttgagattctcattatcttaaaggtggtagcatgctctaaatcatagggaaagtcatctgacagttatcgttcagcctggctatgtagccgaggctaagctgaaacttgtgaccctcttgaccccactcccaagtgctggactttaccaggtgtgcagctccacaccggcctcttcacatgtcctgaagtagacatgagagtcaccagttctttctctcctccccgccccacaggtttcttttgtttccttctacaagcagagaaacagcaacctgaggggcctgtccttccttatgtccagttcaagtgaagatcaagaatctttgtaaaattattggaaatttactgtgtaaatgcttgatggaatcttcttgctagtgtagcttctagaaggtgctttctccatttatttaaaactacccatgcaattaaaaaagcaacgcagcatccccgttgaatgattttaaaaaaaaaaaaaaaaaaaaaaaaaaaaaa

SEQ ID NO: 4334 - DNA, 2214 bp, Macca mulatta
ggctgggcggcggcggcggcggcgcgcggtgcgtagtctcgagctatggtggtggtggcagccgcaccgagtccggccgacggggcccctaaagtactgcttctgtcggggcagcccgcctccgccgccggagccccggccggccaggccctgccgctcatggtgccagcccagagaggggctagcccggaggcagcgagcggggggctgccccaggcgcgcaagcggcagcgcctcacgcatctgagccccgaggagaaggcgctgaggaggaaactgaaaaacagagtagcagctcagactgccagagatcgaaagaaagctcgaatgagtgagctggaacagcaagtggtagatttagaagaagagaaccaaaaacttttgctagaaaatcagcttttacgagagaaaactcacggccttgtagttgagaaccaggagttaagacagcgcctggggatggatgccctggttgctaaagaggaggcggaagccaaggggaatggagtgaggccagtggccgggtctgctgagtccgcagtgcaggcccagttgtcacccctccagaacatctccccatggattctggcggtattgactcttcagattcagagtctgatatcctgttgggcattctggacaacttggacccagtcatgttcttcaaatgcccttccccagagtctgccagcctggaggagctcccagaggtctacccagaaggacccagttccttaccagcctccctttctctgtcagtggggacgtcatcagccaagctggaagccattaatgaactaattcgttttgaccacatatataccaagcccctggtcttagagataccctctgagacagagagccaagctaatgtggtagtgaaaatcgaggaagcacctctcagcccctcagagaatgatcaccctgaattcattgtctcagtgaaggaagaacctgtagaagatgacctcattccagagctgggtatctcaaatctgctttcatccagccactgcccgaaaccatcttcctgcctactggatgcttacagtgactgtggatatgggggctccctttcccccttcagtgacatgtcctctccgcttggtgtaaaccattcttgggaggacacttttgccaatgaactttttccccagctgattagtgtctaaggaatgatccagtactgttgcccttttccttgactattacactgcctggaggatagcagggaagcctgcctgtgcttcattcaaaaagccaaaatagagagtacacagtcctagagaattcctttcaagtatttgttcagatctcatagatgagccccaggtactgtcttttgacatccagcagtccaaagtattgagacatattactgtaattaagaaatattactataattgagaactacagcttttaagattgtacttttatcttaaaagggtggtagtttgccctaaaatacttattatgtaagggtcattagacaaatgtcttgaagtagaatttatgaatggttctttatcatttctcttccccctttttggcatcctggcttgcctccagttttaggtcccttagtttgcttctgtaagcaaagagaacacctgctgagggggctctttccctcacgtatacttcaagtaagatcaagaatcttttgtgaaactatagaaatttactatgtaaatgcttgatggaattttttcctgctagtgtagcttctgaaaggtgctttccatttatttaaaactacccatgcaattaaaaggtacaatgcagcatccttgttctttgatttcttctagggccgtaagtcttattttctctctagttgtttctgtgtgctgtggtaggactttatccaactgaagtgagcctgccacttttaaaagtgactgaaggcttttccaccttaattactgcctgctttaattctggattgccgtaagtgatataagctataatttgagcagttactatctttctgagacagattcttgagcctaactgaccaatatcacagccagtaagtgggagagctagaaccctaaccactatttgctatacgatcttataaatgttaaacaaggacacaccatcacatatcaagattctcttgcccttatcatgggaattaagagcattttctagactcaaactccctagtttcaactctgccactggtaagctgggtaacccaggggttat

SEQ ID NO: 4335 - DNA, 32 bp, Artificial Sequence
  Description of Artificial Sequence: Synthetic oligonucleotide
ggaagcagagagtggagaaagaaatgctaagg

SEQ ID NO: 4336 - DNA, 28 bp, Artificial Sequence
  Description of Artificial Sequence: Synthetic oligonucleotide
cgactggagcacgaggacactgacatgg

SEQ ID NO: 4337 - DNA, 33 bp, Artificial Sequence
  Description of Artificial Sequence: Synthetic oligonucleotide
ccagtgttatgtggctctttagacactaatcag

---

We claim:

1. A double-stranded ribonucleic acid (dsRNA) for inhibiting the expression of an XBP-1 gene, wherein said dsRNA comprises a sense strand and an antisense strand that together form a region of complementarity less than 30 base pairs in length and wherein the antisense strand is complementary to at least 15 contiguous nucleotides of 5' CACCCUGAAUU-CAUUGUCU 3' (SEQ ID NO:2149).

2. The dsRNA of claim 1, wherein said dsRNA comprises at least one modified nucleotide.

3. The dsRNA of claim 2, wherein at least one of said modified nucleotides is chosen from the group of: a 2'-O-methyl modified nucleotide, a nucleotide comprising a 5'-phosphorothioate group, and a terminal nucleotide linked to a cholesteryl derivative, vitamin E, or dodecanoic acid bisdecylamide group.

4. The dsRNA of claim 2, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

5. The dsRNA of claim 1, wherein the region of complementarity is at least 15 nucleotides in length.

6. The dsRNA of claim 1, wherein the region of complementarity is between 19 and 21 nucleotides in length.

7. A cell comprising the dsRNA of claim 1.

8. A pharmaceutical composition for inhibiting expression of an XBP-1 gene comprising the dsRNA of claim 1 and a pharmaceutically acceptable carrier.

9. A method of inhibiting XBP-1 expression in a cell, the method comprising:
 (a) introducing into the cell the dsRNA of claim 1; and
 (b) maintaining the cell produced in step (a) for a time sufficient to obtain degradation of the mRNA transcript of the XBP-1 gene, thereby inhibiting expression of the XBP-1 gene in the cell.

10. A vector comprising a regulatory sequence operably linked to a nucleotide sequence encoding at least one strand of the dsRNA of claim 1.

11. The vector of claim 10, wherein the region of complementarity is at least 15 nucleotides in length.

12. The vector of claim 10, wherein the region of complementarity is 19 to 21 nucleotides in length.

13. A cell comprising the vector of claim 10.

14. The dsRNA of claim 1, wherein the antisense strand comprises SEQ ID NO:2150.

15. The dsRNA of claim 1, wherein the antisense strand consists of SEQ ID NO:2150.

16. The dsRNA of claim 1, wherein the sense strand comprises SEQ ID NO:2149.

17. The dsRNA of claim 1, wherein the sense strand consists of SEQ ID NO:2149.

18. The dsRNA of claim 1, wherein the antisense strand consists of SEQ ID NO:2150 and the sense strand consists of SEQ ID NO:2149.

19. The dsRNA of claim 2 comprising a 5'-phosphorothioate group or a 2'-O-methyl modified nucleotide.

20. The dsRNA of claim 2, wherein the antisense strand comprises SEQ ID NO:2178.

21. The dsRNA of claim 2, wherein the antisense strand consists of SEQ ID NO:2178.

22. The dsRNA of claim 2, wherein the sense strand comprises SEQ ID NO:2177.

23. The dsRNA of claim 2, wherein the sense strand consists of SEQ ID NO:2177.

24. The dsRNA of claim 2, wherein the antisense strand consists of SEQ ID NO:2178 and the sense strand consists of SEQ ID NO:2177.

25. The dsRNA of claim 1 comprising one or more single-stranded nucleotide overhangs.

26. The dsRNA of claim 1 comprising a 3' dinucleotide overhang on the sense strand and a 3' dinucleotide overhang on the antisense strand.

27. The dsRNA of claim 1, wherein the region of complementarity is 19 nucleotides in length.

28. The dsRNA of claim 1, wherein each strand of the dsRNA is 21 nucleotides in length.

* * * * *